US008067189B2

(12) United States Patent
Ayers

(10) Patent No.: US 8,067,189 B2
(45) Date of Patent: Nov. 29, 2011

(54) METHODS FOR DETERMINING SENSITIVITY TO VASCULAR ENDOTHELIAL GROWTH FACTOR RECEPTOR-2 MODULATORS BY MEASURING THE LEVEL OF COLLAGEN TYPE IV

(75) Inventor: Mark David Ayers, Pennington, NJ (US)

(73) Assignee: Bristol-Myers Squibb Company, Princeton, NJ (US)

( * ) Notice: Subject to any disclaimer, the term of this patent is extended or adjusted under 35 U.S.C. 154(b) by 800 days.

(21) Appl. No.: 11/991,351

(22) PCT Filed: Aug. 30, 2006

(86) PCT No.: PCT/US2006/034201
§ 371 (c)(1),
(2), (4) Date: Feb. 29, 2008

(87) PCT Pub. No.: WO2007/028005
PCT Pub. Date: Mar. 8, 2007

(65) Prior Publication Data
US 2009/0098584 A1   Apr. 16, 2009

Related U.S. Application Data

(60) Provisional application No. 60/713,583, filed on Sep. 1, 2005.

(51) Int. Cl.
| | | |
|---|---|---|
| C12Q 1/00 | (2006.01) | |
| C12Q 1/68 | (2006.01) | |
| G01N 1/00 | (2006.01) | |
| G01N 33/48 | (2006.01) | |
| G01N 33/53 | (2006.01) | |
| G01N 33/567 | (2006.01) | |
| G01N 33/574 | (2006.01) | |
| A01N 61/00 | (2006.01) | |
| A61K 31/00 | (2006.01) | |
| A61K 38/16 | (2006.01) | |
| A61K 49/00 | (2006.01) | |

(52) U.S. Cl. ............. 435/7.23; 435/4; 435/6; 435/7.1; 435/7.21; 424/9.1; 436/63; 436/64; 436/174; 514/1; 514/1.1; 514/7.6; 514/8.1

(58) Field of Classification Search ............... 424/9.1; 435/4, 6, 7.1, 7.21, 7.23; 436/63, 64, 174; 514/1, 1.1, 7.6, 8.1
See application file for complete search history.

(56) References Cited

U.S. PATENT DOCUMENTS
| | | | |
|---|---|---|---|
| 5,569,588 A | 10/1996 | Ashby et al. | |
| 2003/0232400 A1 | 12/2003 | Radka et al. | |
| 2004/0076955 A1* | 4/2004 | Mack et al. | ............ 435/6 |
| 2005/0069963 A1 | 3/2005 | Lokshin et al. | |
| 2006/0257400 A1* | 11/2006 | Fargnoli | ............ 424/143.1 |

FOREIGN PATENT DOCUMENTS
WO   WO2005/059179 A   6/2005

OTHER PUBLICATIONS

Alizadeh, A. et al., "Distinct types of diffuse large B-cell lymphoma identified by gene expression profiling", Nature, vol. 403, pp. 503-511 (2000).
Alon, U. et al., "Broad patterns of gene expression revealed by clustering analysis of tumor and normal colon tissues probed by oligonucleotide arrays", PNAS, vol. 96, pp. 6745-6750 (1999).
Bittner, M. et al., "Molecular classification of cutaneous malignant melanoma by gene expression profiling", Nature, vol. 406, pp. 536-540 (2000).
Blanchard, A. et al., "Sequence to array: Probing the genome's secrets", Nature Biotechnology, vol. 14, p. 1649 (1996).
Cockett, M. et al., "Applied genomics: integration of the technology within pharmaceutical research and development", Current Opinion in Biotechnology, vol. 11, pp. 602-609 (2000).
Glinsky, G. et al., "Gene expression profiling predicts clinical outcome of prostate cancer", The J. of Clinical Investigation, vol. 113(6), pp. 913-923 (2004).
Golub, T.R. et al., "Molecular Classification of Cancer: Class Discovery and Class Prediction by Gene Expression Monitoring", Science, vol. 286, pp. 531-537 (1999).
Khan, J. et al., "Classification and diagnostic prediction of cancers using gene expression profiling and artificial neural networks", Nature Medicine, vol. 7(6), pp. 673-679 (2001).
Khan, J. et al., "Gene expression Profiling of Alveolar Rhabdomyosarcoma with cDNA Microarrays", Cancer Research, vol. 58, pp. 5009-5013 (1998).
Lockhart, D. et al., "Expression monitoring by hybridization to high-density oligonucleotide arrays", Nature Biotechnology, vol. 14, pp. 1675-1680 (1996).
Schena, M. et al., "Quantitative Monitoring of Gene Expression Patterns with a Complementary DNA Microarray", Science, vol. 270, pp. 467-470 (1995).
Shipp, M. et al., "Diffuse large B-cell lymphoma outcome prediction by gene-expression profiling and supervised machine learning", Nature Medicine, vol. 8(1), pp. 68-74 (2002).
Sonneveld, S. et al., "Multidrug resistance in haematological malignancies", Journal of Internal Medicine, vol. 247, pp. 521-534 (2000).
Van't Veer, L. et al., "Gene expression profiling predicts clinical outcome of breast cancer", Nature, vol. 415, pp. 530-536 (2002).
Wands, J. et al., "High Affinity Monoclonal antibodies to Hepatitis B Surface Antigen ($HB_sAg$) Produced by Somatic Cell Hybrids", Gastroenterology, vol. 80(2), pp. 225-232 (1981).

* cited by examiner

*Primary Examiner* — Alana H Dent
(74) *Attorney, Agent, or Firm* — Paul D. Golian

(57) ABSTRACT

VEGFR-2 biomarkers useful in a method for identifying and monitoring a mammal that will respond therapeutically to a method of treating cancer comprising administering an VEGFR-2 modulator, wherein the method comprises (a) exposing the mammal to the VEGFR-2 modulator and (b) measuring in the mammal the level of the at least one biomarker, wherein a difference in the level of the at least one biomarker measured in (b) compared to the level of the biomarker in a mammal that has not been exposed to the VEGFR-2 modulator indicates that the mammal will respond therapeutically to the method of treating cancer and (c) wherein the level of the biomarker in a mammal after exposure to a VEGFR-2 modulator indicates that the mammal has responded therapeutically to the method of treating cancer.

2 Claims, 9 Drawing Sheets ental methods (J. Khan et al., Cancer Res., 58:5009-5013 (1998); A. A. Alizadeh et al.,
METHODS FOR DETERMINING SENSITIVITY TO VASCULAR ENDOTHELIAL GROWTH FACTOR RECEPTOR-2 MODULATORS BY MEASURING THE LEVEL OF COLLAGEN TYPE IV

SEQUENCE LISTING

A compact disc labeled "Copy 1" contains the Sequence Listing as 10661 PCT.ST25.txt. The Sequence Listing is 828 KB in size and was recorded Aug. 30, 2006. The compact disk is 1 of 2 compact disks. A duplicate copy of the compact disc is labeled "Copy 2" and is 2 of 2 compact discs.

The compact disc and duplicate copy are identical and are hereby incorporated by reference into the present application.

FIELD OF THE INVENTION

The present invention relates generally to the field of pharmacogenomics, and more specifically, to methods and procedures used to monitor response or determine sensitivity in patients to allow the identification of individualized genetic profiles which will aid in treating diseases and disorders.

BACKGROUND OF THE INVENTION

Cancer is a disease with extensive histoclinical heterogeneity. Although conventional histological and clinical features have been correlated to prognosis, the same apparent prognostic type of tumors varies widely in its responsiveness to therapy and consequent survival of the patient.

New prognostic and predictive markers, which would facilitate an individualization of therapy for each patient, are needed to accurately predict patient response to treatments, such as small molecule or biological molecule drugs, in the clinic. The problem may be solved by the identification of new parameters that could better predict the patient's sensitivity to treatment. The classification of patient samples is a crucial aspect of cancer diagnosis and treatment. The association of a patient's response to a treatment with molecular and genetic markers can open up new opportunities for treatment development in non-responding patients, or distinguish a treatment's indication among other treatment choices because of higher confidence in the efficacy. Further, the pre-selection of patients who are likely to respond well to a medicine, drug, or combination therapy may reduce the number of patients needed in a clinical study or accelerate the time needed to complete a clinical development program (M. Cockett et al., Current Opinion in Biotechnology, 11:602-609 (2000)).

The ability to determine which patients are responding to anti-angiogenesis therapies (such as VEGFR-2 modulators) or predict drug sensitivity in patients is particularly challenging because drug responses reflect not only properties intrinsic to the target cells, but also a host's metabolic properties. Efforts to use genetic information to predict or monitor drug response have primarily focused on individual genes that have broad effects, such as the multidrug resistance genes mdr1 and mrp1 (P. Sonneveld, J. Intern. Med., 247:521-534 (2000)).

The development of microarray technologies for large scale characterization of gene mRNA expression pattern has made it possible to systematically search for molecular markers and to categorize cancers into distinct subgroups not evident by traditional histopathological methods (J. Khan et al., Cancer Res., 58:5009-5013 (1998); A. A. Alizadeh et al., Nature, 403:503-511 (2000); M. Bittner et al., Nature, 406:536-540 (2000); J. Khan et al., Nature Medicine, 7(6):673-679 (2001); and T. R. Golub et al., Science, 286:531-537 (1999); U. Alon et al., P. N. A. S. USA, 96:6745-6750 (1999)). Such technologies and molecular tools have made it possible to monitor the expression level of a large number of transcripts within a cell population at any given time (see, e.g., Schena et al., Science, 270:467-470 (1995); Lockhart et al., Nature Biotechnology, 14:1675-1680 (1996); Blanchard et al., Nature Biotechnology, 14:1649 (1996); U.S. Pat. No. 5,569,588 to Ashby et al.).

Recent studies demonstrate that gene expression information generated by microarray analysis of human tumors can predict clinical outcome (L. J. van't Veer et al., Nature, 415:530-536 (2002); M. Shipp et al., Nature Medicine, 8(1):68-74 (2002); G. Glinsky et al., The Journal of Clin. Invest, 113(6):913-923 (2004)). These findings bring hope that cancer treatment will be vastly improved by better predicting and monitoring the response of individual tumors to therapy.

Needed are new and alternative methods and procedures to determine drug sensitivity or monitor response in patients to allow the development of individualized diagnostics which are necessary to treat diseases and disorders based on patient response at a molecular level.

SUMMARY OF THE INVENTION

The invention provides methods and procedures for determining patient sensitivity or monitor response at the molecular level to one or more vascular endothelial growth factor receptor 2 (VEGFR-2) modulators. The invention also provides methods of determining or predicting whether an individual requiring therapy for a disease state such as cancer will or will not respond to treatment, prior to administration of the treatment, wherein the treatment comprises administration of one or more VEGFR-2 modulators. The one or more VEGFR-2 modulators are compounds that can be selected from, for example, one or more VEGFR-2 specific ligands, one or more small molecule VEGFR-2 inhibitors, or one or more VEGFR-2 binding monoclonal antibodies.

In one aspect, the invention provides a method for identifying a mammal that will respond therapeutically to a method of treating cancer comprising administering an VEGFR-2 modulator, wherein the method comprises: (a) measuring in the mammal the level of at least one biomarker selected from the biomarkers of Table 1; (b) exposing a biological sample from the mammal to the VEGFR-2 modulator; (c) following the exposing in step (b), measuring in said biological sample the level of the at least one biomarker, wherein a difference in the level of the at least one biomarker measured in step (c) compared to the level of the at least one biomarker measured in step (a) indicates that the mammal will respond therapeutically to said method of treating cancer.

A difference in the level of the biomarker that is sufficient to indicate whether the mammal will or will not respond therapeutically to the method of treating cancer can be readily determined by one of skill in the art using known techniques. The increase or decrease in the level of the biomarker can be correlated to determine whether the difference is sufficient to identify a mammal that will respond therapeutically. The difference in the level of the biomarker that is sufficient can, in one aspect, be predetermined prior to determining whether the mammal will respond therapeutically to the treatment. In one aspect, the difference in the level of the biomarker is a difference in the mRNA level (measured, for example, by RT-PCR or a microarray), such as at least a two-fold difference, at least a three-fold difference, or at least a four-fold difference in the level of expression. In another aspect, the difference in the level of the biomarker is determined by IHC. In another aspect, the difference in the level of the biomarker refers to a p-value of <0.05 in Anova analysis. In yet another aspect, the difference is determined in an ELISA assay.

As used herein, respond therapeutically refers to the alleviation or abrogation of the cancer. This means that the life expectancy of an individual affected with the cancer will be increased or that one or more of the symptoms of the cancer will be reduced or ameliorated. The term encompasses a reduction in cancerous cell growth or tumor volume. Whether a mammal responds therapeutically can be measured by many methods well known in the art, such as PET imaging.

The mammal can be, for example, a human, rat, mouse, dog rabbit, pig sheep, cow, horse, cat, primate, or monkey.

The method of the invention can be, for example, an in vitro method wherein the step of measuring in the mammal the level of at least one biomarker comprises taking a biological sample from the mammal and then measuring the level of the biomarker(s) in the biological sample. The biological sample can comprise, for example, at least one of serum, whole fresh blood, peripheral blood mononuclear cells, frozen whole blood, fresh plasma, frozen plasma, urine, saliva, skin, hair follicle, bone marrow, or tumor tissue.

The level of the at least one biomarker can be, for example, the level of protein and/or mRNA transcript of the biomarker(s).

In another aspect, the invention provides a method for identifying a mammal that will respond therapeutically to a method of treating cancer comprising administering an VEGFR-2 modulator, wherein the method comprises: (a) exposing a biological sample from the mammal to the VEGFR-2 modulator; (b) following the exposing of step (a), measuring in said biological sample the level of at least one biomarker selected from the biomarkers of Table 1, wherein a difference in the level of the at least one biomarker measured in step (b), compared to the level of the biomarker in a mammal that has not been exposed to said VEGFR-2 modulator, indicates that the mammal will respond therapeutically to said method of treating cancer.

In yet another aspect, the invention provides a method for testing or predicting whether a mammal will respond therapeutically to a method of treating cancer comprising administering an VEGFR-2 modulator, wherein the method comprises: (a) measuring in the mammal the level of at least one biomarker selected from the biomarkers of Table 1; (b) exposing the mammal to the VEGFR-2 modulator; (c) following the exposing of step (b), measuring in the mammal the level of the at least one biomarker, wherein a difference in the level of the at least one biomarker measured in step (c) compared to the level of the at least one biomarker measured in step (a) indicates that the mammal will respond therapeutically to said method of treating cancer.

In another aspect, the invention provides a method for determining whether a compound inhibits VEGFR-2 activity in a mammal, comprising: (a) exposing the mammal to the compound; and (b) following the exposing of step (a), measuring in the mammal the level of at least one biomarker selected from the biomarkers of Table 1, wherein a difference in the level of said biomarker measured in step (b), compared to the level of the biomarker in a mammal that has not been exposed to said compound, indicates that the compound inhibits VEGFR-2 activity in the mammal.

In yet another aspect, the invention provides a method for determining whether a mammal has been exposed to a compound that inhibits VEGFR-2 activity, comprising (a) exposing the mammal to the compound; and (b) following the exposing of step (a), measuring in the mammal the level of at least one biomarker selected from the biomarkers of Table 1, wherein a difference in the level of said biomarker measured in step (b), compared to the level of the biomarker in a mammal that has not been exposed to said compound, indicates that the mammal has been exposed to a compound that inhibits VEGFR-2 activity.

In another aspect, the invention provides a method for determining whether a mammal is responding to a compound that inhibits VEGFR-2 activity, comprising (a) exposing the mammal to the compound; and (b) following the exposing of step (a), measuring in the mammal the level of at least one biomarker selected from the biomarkers of Table 1, wherein a difference in the level of the at least one biomarker measured in step (b), compared to the level of the at least one biomarker in a mammal that has not been exposed to said compound, indicates that the mammal is responding to the compound that inhibits VEGFR-2 activity.

As used herein, "responding" encompasses responding by way of a biological and cellular response, as well as a clinical response (such as improved symptoms, a therapeutic effect, or an adverse event), in a mammal The invention also provides an isolated biomarker selected from the biomarkers of Table 1. The biomarkers of the invention comprise sequences selected from the nucleotide and amino acid sequences provided in Table 1 and the Sequence Listing, as well as fragments and variants thereof.

The invention also provides a biomarker set comprising two or more biomarkers selected from the biomarkers of Table 1.

The invention also provides kits for determining or predicting whether a patient would be susceptible or resistant to a treatment that comprises one or more VEGFR-2 modulators. The patient may have a cancer or tumor such as, for example, a colon cancer or tumor.

In one aspect, the kit comprises a suitable container that comprises one or more specialized microarrays of the invention, one or more VEGFR-2 modulators for use in testing cells from patient tissue specimens or patient samples, and instructions for use. The kit may further comprise reagents or materials for monitoring the expression of a biomarker set at the level of mRNA or protein.

In another aspect, the invention provides a kit comprising two or more biomarkers selected from the biomarkers of Table 1.

In yet another aspect, the invention provides a kit comprising at least one of an antibody and a nucleic acid for detecting the presence of at least one of the biomarkers selected from the biomarkers of Table 1. In one aspect, the kit further comprises instructions for determining whether or not a mammal will respond therapeutically to a method of treating cancer comprising administering a compound that inhibits VEGFR-2 activity. In another aspect, the instructions comprise the steps of (a) measuring in the mammal the level of at least one biomarker selected from the biomarkers of Table 1, (b) exposing the mammal to the compound, (c) following the exposing of step (b), measuring in the mammal the level of the at least one biomarker, wherein a difference in the level of the at least one biomarker measured in step (c) compared to the level of the at least one biomarker measured in step (a) indicates that the mammal will respond therapeutically to said method of treating cancer.

The invention also provides screening assays for determining if a patient will be susceptible or resistant to treatment with one or more VEGFR-2 modulators.

The invention also provides a method of monitoring the treatment of a patient having a disease, wherein said disease is treated by a method comprising administering one or more VEGFR-2 modulators.

The invention also provides individualized genetic profiles which are necessary to treat diseases and disorders based on patient response at a molecular level.

The invention also provides specialized microarrays, e.g., oligonucleotide microarrays or cDNA microarrays, comprising one or more biomarkers having expression profiles that correlate with either sensitivity or resistance to one or more VEGFR-2 modulators.

The invention also provides antibodies, including polyclonal or monoclonal, directed against one or more biomarkers of the invention.

The invention will be better understood upon a reading of the detailed description of the invention when considered in connection with the accompanying figures.

DETAILED DESCRIPTION OF THE INVENTION

Figure 1:
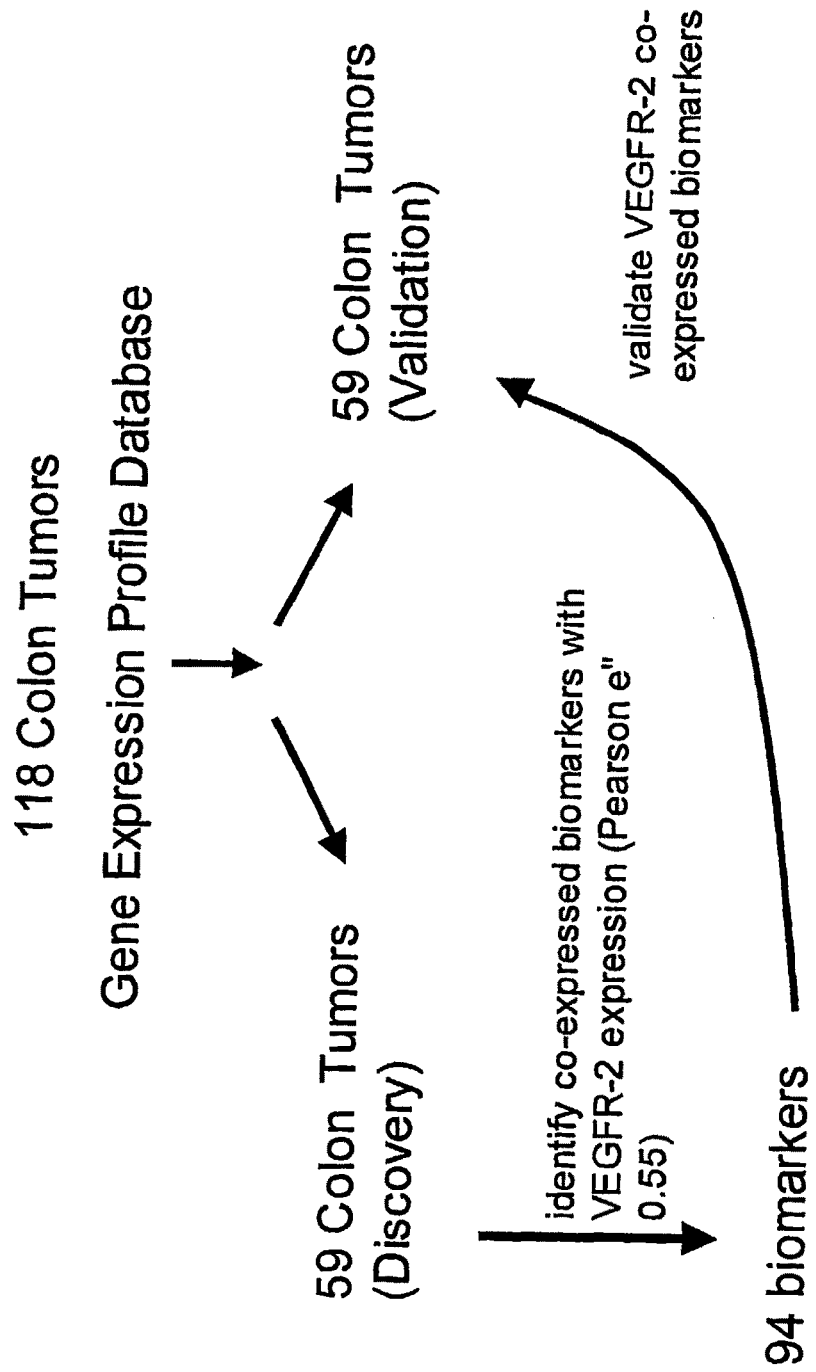
FIG. 1 illustrates the method used for the discovery and validation of genes co-expressed with VEGFR-2 in human tumor gene expression profiles.

Identification of biomarkers that provide rapid and accessible readouts of efficacy, drug exposure, or clinical response is increasingly important in the clinical development of drug candidates. Embodiments of the invention include measuring changes in the levels of secreted proteins, or plasma biomarkers, which represent one category of biomarker. In one aspect, plasma samples, which represent a readily accessible source of material, serve as surrogate tissue for biomarker analysis.

The invention provides biomarkers that respond to the modulation of a specific signal transduction pathway and also correlate with VEGFR-2 modulator sensitivity or resistance. These biomarkers can be employed for predicting and monitoring response to one or more VEGFR-2 modulators. In one aspect, the biomarkers of the invention are those provided in Tables 1 and 2 and the Sequence Listing, including both polynucleotide and polypeptide sequences.

TABLE 1

VEGFR-2 Biomarkers

| Unigene title and SEQ ID NO: | Affymetrix Description | Affymetrix Probe Set |
|---|---|---|
| KDR: kinase insert domain receptor (a type III receptor tyrosine kinase) (LOC3791) SEQ ID NOS: 1 (DNA) and 95 (amino acid) | gb: NM_002253.1 /DEF = *Homo sapiens* kinase insert domain receptor (a type III receptor tyrosine kinase) (KDR), mRNA. /FEA = mRNA /GEN = KDR /PROD = kinase insert domain receptor (a type IIIreceptor tyrosine kinase) /DB_XREF = gi: 11321596 /UG = Hs.12337 kinase insert domain receptor (a type III receptor tyrosine kinase) /FL = gb: NM_002253.1 gb: AF035121.1 gb: AF063658.1 | 203934_at |
| GJA4: gap junction protein, alpha 4, 37 kDa (connexin 37) (LOC2701) SEQ ID NOS: 2 (DNA) and 96 (amino acid) | Cluster Incl. M96789: *Homo sapiens* connexin 37 (GJA4) mRNA, complete cds /cds = (64,1065) /gb = M96789 /gi = 183222 /ug = Hs.83468 /len = 1591 | 40687_at |
| C1QR1: complement component 1, q subcomponent, receptor 1 (LOC22918) SEQ ID NOS: 3 (DNA) and 97 (amino acid) | gb: NM_012072.2 /DEF = *Homo sapiens* complement component C1q receptor (C1QR), mRNA. /FEA = mRNA /GEN = C1QR /PROD = complement component C1q receptor /DB_XREF = gi: 11496985 /UG = Hs.97199 complement component C1q receptor /FL = gb: NM_012072.2 gb: U94333.1 | 202878_s_at |
| CDH5: cadherin 5, type 2, VE-cadherin (vascular epithelium) (LOC1003) | gb: NM_001795.1 /DEF = *Homo sapiens* cadherin 5, type 2, VE-cadherin (vascular epithelium) | 204677_at |

TABLE 1-continued

VEGFR-2 Biomarkers

| Unigene title and SEQ ID NO: | Affymetrix Description | Affymetrix Probe Set |
|---|---|---|
| SEQ ID NOS: 4 (DNA) and 98 (amino acid) | (CDH5), mRNA. /FEA = mRNA /GEN = CDH5 /PROD = cadherin 5, type 2, VE-cadherin (vascularepithelium) /DB_XREF = gi: 4502726 /UG = Hs.76206 cadherin 5, type 2, VE-cadherin (vascular epithelium) /FL = gb: U84722.1 gb: NM_001795.1 gb: AB035304.1 | |
| GPR116: G protein-coupled receptor 116 (LOC221395) SEQ ID NOS: 5 (DNA) and 99 (amino acid) | Consensus includes gb: BF941499 /FEA = EST /DB_XREF = gi: 12358819 /DB_XREF = est: nac74e09.x1 /CLONE = IMAGE: 3439985 /UG = Hs.22039 KIAA0758 protein | 212950_at |
| CALCRL: calcitonin receptor-like (LOC10203) SEQ ID NOS: 6 (DNA) and 100 (amino acid) | gb: NM_005795.1 /DEF = *Homo sapiens* calcitonin receptor-like (CALCRL), mRNA. /FEA = mRNA /GEN = CALCRL /PROD = calcitonin receptor-like /DB_XREF = gi: 5031620 /UG = Hs.152175 calcitonin receptor-like /FL = gb: L76380.1 gb: NM_005795.1 | 206331_at |
| AGTRL1: angiotensin II receptor-like 1 (LOC187) SEQ ID NOS: 7 (DNA) and 101 (amino acid) | Consensus includes gb: X89271.1 /DEF = H. sapiens mRNA for HG11 orphan receptor. /FEA = mRNA /GEN = HG11 /PROD = HG11 orphan receptor /DB_XREF = gi: 6911643 /UG = Hs.9305 angiotensin receptor-like 1 /FL = gb: NM_005161.1 | 213592_at |
| MMRN2: multimerin 2 (LOC79812) SEQ ID NOS: 8 (DNA) and 102 (amino acid) | gb: NM_024756.1 /DEF = *Homo sapiens* hypothetical protein FLJ13465 (FLJ13465), mRNA. /FEA = mRNA /GEN = FLJ13465 /PROD = hypothetical protein FLJ13465 /DB_XREF = gi: 13376090 /UG = Hs.127216 hypothetical protein FLJ13465 /FL = gb: NM_024756.1 | 219091_s_at |
| ELTD1: EGF, latrophilin and seven transmembrane domain containing 1 (LOC64123) SEQ ID NOS: 9 (DNA) and 103 (amino acid) | gb: NM_022159.1 /DEF = *Homo sapiens* ETL protein (ETL), mRNA. /FEA = mRNA /GEN = ETL /PROD = ETL protein /DB_XREF = gi: 11545907 /UG = Hs.57958 EGF-TM7-latrophilin-related protein /FL = gb: AF192403.1 gb: NM_022159.1 | 219134_at |
| CCL11: chemokine (C-C motif) ligand 11 (LOC6356) SEQ ID NOS: 10 (DNA) and 104 (amino acid) | gb: D49372.1 /DEF = Human mRNA for eotaxin, complete cds. /FEA = mRNA /PROD = eotaxin /DB_XREF = gi: 1552240 /UG = Hs.54460 small inducible cytokine subfamily A (Cys-Cys), member 11 (eotaxin) /FL = gb: U46573.1 gb: D49372.1 gb: NM_002986.1 | 210133_at |
| EDG1: endothelial differentiation, sphingolipid G-protein-coupled receptor, 1 (LOC1901) SEQ ID NOS: 11 (DNA) and 105 (amino acid) | gb: NM_001400.2 /DEF = *Homo sapiens* endothelial differentiation, sphingolipid G-protein-coupled receptor, 1 (EDG1), mRNA. /FEA = mRNA /GEN = EDG1 /PROD = endothelial differentiation, sphingolipidG-protein-coupled receptor, 1 /DB_XREF = gi: 13027635 /UG = Hs.154210 endothelial differentiation, sphingolipid G-protein-coupled receptor, 1 /FL = gb: NM_001400.2 gb: M31210.1 gb: AF233365.1 | 204642_at |

TABLE 1-continued

VEGFR-2 Biomarkers

| Unigene title and SEQ ID NO: | Affymetrix Description | Affymetrix Probe Set |
|---|---|---|
| C1QR1: complement component 1, q subcomponent, receptor 1 (LOC22918) SEQ ID NOS: 12 (DNA) and 106 (amino acid) | Consensus includes gb: W72082 /FEA = EST /DB_XREF = gi: 1382588 /DB_XREF = est: zd70c06.s1 /CLONE = IMAGE: 345994 /UG = Hs.97199 complement component C1q receptor /FL = gb: NM_012072.2 gb: U94333.1 | 202877_s_at |
| LPHN2: latrophilin 2 (LOC23266) SEQ ID NOS: 13 (DNA) and 107 (amino acid) | gb: NM_012302.1 /DEF = *Homo sapiens* latrophilin (KIAA0786), mRNA. /FEA = mRNA /GEN = KIAA0786 /PROD = latrophilin /DB_XREF = gi: 6912463 /UG = Hs.24212 latrophilin /FL = gb: AF104939.1 gb: NM_012302.1 | 206953_s_at |
| COL15A1: collagen, type XV, alpha 1 (LOC1306) SEQ ID NOS: 14 (DNA) and 108 (amino acid) | gb: NM_001855.1 /DEF = *Homo sapiens* collagen, type XV, alpha 1 (COL15A1), mRNA. /FEA = mRNA /GEN = COL15A1 /PROD = collagen, type XV, alpha 1 /DB_XREF = gi: 4502940 /UG = Hs.83164 collagen, type XV, alpha 1 /FL = gb: NM_001855.1 gb: L25286.1 | 203477_at |
| TNC: tenascin C (hexabrachion) (LOC3371) SEQ ID NOS: 15 (DNA) and 109 (amino acid) | gb: NM_002160.1 /DEF = *Homo sapiens* hexabrachion (tenascin C, cytotactin) (HXB), mRNA. /FEA = mRNA /GEN = HXB /PROD = hexabrachion (tenascin C, cytotactin) /DB_XREF = gi: 4504548 /UG = Hs.289114 hexabrachion (tenascin C, cytotactin) /FL = gb: M55618.1 gb: NM_002160.1 | 201645_at |
| —: Transcribed sequences (LOC—) SEQ ID NOS: 16 (DNA) | Consensus includes gb: AW973834 /FEA = EST /DB_XREF = gi: 8165022 /DB_XREF = est: EST385936 /UG = Hs.105884 ESTs | 222326_at |
| TEK: TEK tyrosine kinase, endothelial (venous malformations, multiple cutaneous and mucosal) (LOC7010) SEQ ID NOS: 17 (DNA) and 110 (amino acid) | gb: NM_000459.1 /DEF = *Homo sapiens* TEK tyrosine kinase, endothelial (venous malformations, multiple cutaneous and mucosal) (TEK), mRNA. /FEA = mRNA /GEN = TEK /PROD = TEK tyrosine kinase, endothelial /DB_XREF = gi: 4557868 /UG = Hs.89640 TEK tyrosine kinase, endothelial (venous malformations, multiple cutaneous and mucosal) /FL = gb: L06139.1 gb: NM_000459.1 | 206702_at |
| CCL2: chemokine (C-C motif) ligand 2 (LOC6347) SEQ ID NOS: 18 (DNA) and 111 (amino acid) | Consensus includes gb: S69738.1 /DEF = MCP-1 = monocyte chemotactic protein human, aortic endothelial cells, mRNA, 661 nt. /FEA = mRNA /GEN = MCP-1 /PROD = MCP-1 /DB_XREF = gi: 545464 /UG = Hs.303649 small inducible cytokine A2 (monocyte chemotactic protein 1, homologous to mouse Sig-je) | 216598_s_at |
| KCNJ8: potassium inwardly-rectifying channel, subfamily J, member 8 (LOC3764) SEQ ID NOS: 19 (DNA) and 112 (amino acid) | gb: NM_004982.1 /DEF = *Homo sapiens* potassium inwardly-rectifying channel, subfamily J, member 8 (KCNJ8), mRNA. /FEA = mRNA /GEN = KCNJ8 /PROD = potassium inwardly-rectifying channel, subfamilyJ, member 8 /DB_XREF = gi: 4826801 | 205304_s_at |

TABLE 1-continued

VEGFR-2 Biomarkers

| Unigene title and SEQ ID NO: | Affymetrix Description | Affymetrix Probe Set |
|---|---|---|
| | /UG = Hs.102308 potassium inwardly-rectifying channel, subfamily J, member 8 /FL = gb: D50312.1 gb: BC000544.1 gb: NM_004982.1 | |
| GNG11: guanine nucleotide binding protein (G protein), gamma 11 (LOC2791) SEQ ID NOS: 20 (DNA) and 113 (amino acid) | gb: NM_004126.1 /DEF = *Homo sapiens* guanine nucleotide binding protein 11 (GNG11), mRNA. /FEA = mRNA /GEN = GNG11 /PROD = guanine nucleotide binding protein 11 /DB_XREF = gi: 4758447 /UG = Hs.83381 guanine nucleotide binding protein 11 /FL = gb: NM_004126.1 gb: U31384.1 | 204115_at |
| PCDH17: protocadherin 17 (LOC27253) SEQ ID NOS: 21 (DNA) and 114 (amino acid) | gb: NM_014459.1 /DEF = *Homo sapiens* protocadherin 17 (PCDH17), mRNA. /FEA = mRNA /GEN = PCDH17 /PROD = protocadherin 17 /DB_XREF = gi: 7657446 /UG = Hs.106511 protocadherin 17 /FL = gb: AF029343.1 gb: NM_014459.1 | 205656_at |
| PECAM1: platelet/endothelial cell adhesion molecule (CD31 antigen) (LOC5175) SEQ ID NOS: 22 (DNA) and 115 (amino acid) | Consensus includes gb: AW574504 /FEA = EST /DB_XREF = gi: 7246055 /DB_XREF = est: UI-HF-BK0-aab-h-05-0-UI.s1 /CLONE = IMAGE: 3053409 /UG = Hs.78146 plateletendothelial cell adhesion molecule (CD31 antigen) /FL = gb: M37780.1 gb: M28526.1 gb: NM_000442.1 | 208982_at |
| PPAP2B: phosphatidic acid phosphatase type 2B (LOC8613) SEQ ID NOS: 23 (DNA) and 116 (amino acid) | gb: AB000889.1 /DEF = *Homo sapiens* mRNA for phosphatidic acid phosphatase 2b, complete cds. /FEA = mRNA /PROD = phosphatidic acid phosphatase 2b /DB_XREF = gi: 2467299 /UG = Hs.331371 phosphatidic acid phosphatase type 2B /FL = gb: U79294.1 gb: AB000889.1 gb: AF017786.1 | 209355_s_at |
| PECAM1: platelet/endothelial cell adhesion molecule (CD31 antigen) (LOC5175) SEQ ID NOS: 24 (DNA) and 117 (amino acid) | Consensus includes gb: AA702701 /FEA = EST /DB_XREF = gi: 2705814 /DB_XREF = est: zi90h02.s1 /CLONE = IMAGE: 448083 /UG = Hs.78146 plateletendothelial cell adhesion molecule (CD31 antigen) /FL = gb: M37780.1 gb: M28526.1 gb: NM_000442.1 | 208981_at |
| COL16A1: collagen, type XVI, alpha 1 (LOC1307) SEQ ID NOS: 25 (DNA) and 118 (amino acid) | gb: NM_001856.1 /DEF = *Homo sapiens* collagen, type XVI, alpha 1 (COL16A1), mRNA. /FEA = mRNA /GEN = COL16A1 /PROD = collagen, type XVI, alpha 1 /DB_XREF = gi: 11386158 /UG = Hs.26208 collagen, type XVI, alpha 1 /FL = gb: NM_001856.1 gb: M92642.1 | 204345_at |
| NR3C1: nuclear receptor subfamily 3, group C, member 1 (glucocorticoid receptor) (LOC2908) SEQ ID NOS: 26 (DNA) and 119 (amino acid) | Consensus includes gb: X03348.1 /DEF = Human mRNA for beta-glucocorticoid receptor (clone OB10). /FEA = mRNA /PROD = beta-glucocorticoid receptor /DB_XREF = gi: 31681 /UG = Hs.75772 nuclear receptor subfamily 3, group C, member 1 | 216321_s_at |
| PECAM1: platelet/endothelial cell adhesion molecule (CD31 | gb: M37780.1 /DEF = Human leukocyte surface protein (CD31) mRNA, complete cds. | 208983_s_at |

TABLE 1-continued

VEGFR-2 Biomarkers

| Unigene title and SEQ ID NO: | Affymetrix Description | Affymetrix Probe Set |
|---|---|---|
| antigen) (LOC5175) SEQ ID NOS: 27 (DNA) and 120 (amino acid) | /FEA = mRNA /GEN = CD31 /PROD = leukocyte surface protein /DB_XREF = gi: 187239 /UG = Hs.78146 plateletendothelial cell adhesion molecule (CD31 antigen) /FL = gb: M37780.1 gb: M28526.1 gb: NM_000442.1 | |
| RAMP3: receptor (calcitonin) activity modifying protein 3 (LOC10268) SEQ ID NOS: 28 (DNA) and 121 (amino acid) | gb: NM_005856.1 /DEF = Homo sapiens receptor (calcitonin) activity modifying protein 3 (RAMP3), mRNA. /FEA = mRNA /GEN = RAMP3 /PROD = receptor (calcitonin) activity modifying protein3 precursor /DB_XREF = gi: 5032022 /UG = Hs.25691 receptor (calcitonin) activity modifying protein 3 /FL = gb: NM_005856.1 | 205326_at |
| MCAM: melanoma cell adhesion molecule (LOC4162) SEQ ID NOS: 29 (DNA) and 122 (amino acid) | gb: AF089868.1 /DEF = Homo sapiens cell surface glycoprotein P1H12 precursor, mRNA, complete cds. /FEA = mRNA /PROD = cell surface glycoprotein P1H12 precursor /DB_XREF = gi: 4336423 /UG = Hs.211579 melanoma adhesion molecule /FL = gb: AF089868.1 gb: NM_006500.1 | 209087_x_at |
| TCF4: transcription factor 4 (LOC6925) SEQ ID NOS: 30 (DNA) and 123 (amino acid) | gb: NM_003199.1 /DEF = Homo sapiens transcription factor 4 (TCF4), mRNA. /FEA = mRNA /GEN = TCF4 /PROD = transcription factor 4, isoform b /DB_XREF = gi: 4507398 /UG = Hs.326198 transcription factor 4 /FL = gb: M74719.1 gb: NM_003199.1 | 203753_at |
| MCAM: melanoma cell adhesion molecule (LOC4162) SEQ ID NOS: 31 (DNA) and 124 (amino acid) | gb: M29277.1 /DEF = Human isolate JuSo MUC18 glycoprotein mRNA (3 variant), complete cds. /FEA = mRNA /PROD = MUC18 glycoprotein /DB_XREF = gi: 530047 /UG = Hs.211579 melanoma adhesion molecule /FL = gb: M29277.1 | 210869_s_at |
| CPE: carboxypeptidase E (LOC1363) SEQ ID NOS: 32 (DNA) and 125 (amino acid) | gb: NM_001873.1 /DEF = Homo sapiens carboxypeptidase E (CPE), mRNA. /FEA = mRNA /GEN = CPE /PROD = carboxypeptidase E precursor /DB_XREF = gi: 4503008 /UG = Hs.75360 carboxypeptidase E /FL = gb: NM_001873.1 | 201117_s_at |
| PLVAP: plasmalemma vesicle associated protein (LOC83483) SEQ ID NOS: 33 (DNA) and 126 (amino acid) | gb: AF326591.1 /DEF = Homo sapiens fenestrated-endothelial linked structure protein (FELS) mRNA, complete cds. /FEA = mRNA /GEN = FELS /PROD = fenestrated-endothelial linked structureprotein /DB_XREF = gi: 12963352 /UG = Hs.107125 Homo sapiens PV1 protein (PLVAP) mRNA, complete cds /FL = gb: AF326591.1 gb: AF348827.1 | 221529_s_at |
| COL4A1: collagen, type IV, alpha 1 (LOC1282) SEQ ID NOS: 34 (DNA) and 127 (amino acid) | Consensus includes gb: AI922605 /FEA = EST /DB_XREF = gi: 5658569 /DB_XREF = est: wm90c05.x1 /CLONE = IMAGE: 2443208 /UG = Hs.119129 collagen, type IV, alpha 1 /FL = gb: NM_001845.1 | 211980_at |
| PRND: prion protein 2 (dublet) (LOC23627) | Consensus includes gb: AL133396 /DEF = Human DNA sequence from | 222106_at |

TABLE 1-continued

VEGFR-2 Biomarkers

| Unigene title and SEQ ID NO: | Affymetrix Description | Affymetrix Probe Set |
|---|---|---|
| SEQ ID NOS: 35 (DNA) and 128 (amino acid) | clone RP5-1068H6 on chromosome 20q11.1-11.23. Contains a pseudogene similar to IDI1 (isopentenyl-diphosphate delta isomerase), the gene for the prion protein like doppel protein, the PRNP gene for prion protein (p27-30) (Cr . . . /FEA = mRNA_1 /DB_XREF = gi: 6562003 /UG = Hs.121281 prion and complex, downstream /FL = gb: NM_012409.1 | |
| MCAM: melanoma cell adhesion molecule (LOC4162) SEQ ID NOS: 36 (DNA) and 129 (amino acid) | gb: M28882.1 /DEF = Human MUC18 glycoprotein mRNA, complete cds. /FEA = mRNA /PROD = MUC18 glycoprotein /DB_XREF = gi: 529723 /UG = Hs.211579 melanoma adhesion molecule /FL = gb: M28882.1 | 211340_s_at |
| EMCN: endomucin (LOC51705) SEQ ID NOS: 37 (DNA) and 130 (amino acid) | gb: NM_016242.1 /DEF = *Homo sapiens* endomucin-2 (LOC51705), mRNA. /FEA = mRNA /GEN = LOC51705 /PROD = endomucin-2 /DB_XREF = gi: 7706452 /UG = Hs.41135 endomucin-2 /FL = gb: AB034695.1 gb: NM_016242.1 gb: AF205940.1 | 219436_s_at |
| PPAP2A: phosphatidic acid phosphatase type 2A (LOC8611) SEQ ID NOS: 38 (DNA) and 131 (amino acid) | gb: AF014403.1 /DEF = *Homo sapiens* type-2 phosphatidic acid phosphatase alpha-2 (PAP2-a2) mRNA, complete cds. /FEA = mRNA /GEN = PAP2-a2 /PROD = type-2 phosphatidic acid phosphatase alpha-2 /DB_XREF = gi: 3123849 /UG = Hs.41569 phosphatidic acid phosphatase type 2A /FL = gb: AF014403.1 | 210946_at |
| D2S448: Melanoma associated gene (LOC7837) SEQ ID NOS: 39 (DNA) and 132 (amino acid) | Consensus includes gb: BF342851 /FEA = EST /DB_XREF = gi: 11289878 /DB_XREF = est: 602015135F1 /CLONE = IMAGE: 4150664 /UG = Hs. 118893 Melanoma associated gene | 212012_at |
| VWF: von Willebrand factor (LOC7450) SEQ ID NOS: 40 (DNA) and 133 (amino acid) | gb: NM_000552.2 /DEF = *Homo sapiens* von Willebrand factor (VWF), mRNA. /FEA = mRNA /GEN = VWF /PROD = von Willebrand factor precursor /DB_XREF = gi: 9257255 /UG = Hs.110802 von Willebrand factor /FL = gb: NM_000552.2 | 202112_at |
| IL6R: interleukin 6 receptor (LOC3570) SEQ ID NOS: 41 (DNA) and 134 (amino acid) | gb: NM_000565.1 /DEF = *Homo sapiens* interleukin 6 receptor (IL6R), mRNA. /FEA = mRNA /GEN = IL6R /PROD = interleukin 6 receptor /DB_XREF = gi: 4504672 /UG = Hs.193400 interleukin 6 receptor /FL = gb: NM_000565.1 | 205945_at |
| TNFAIP6: tumor necrosis factor, alpha-induced protein 6 (LOC7130) SEQ ID NOS: 42 (DNA) and 135 (amino acid) | Consensus includes gb: AW188198 /FEA = EST /DB_XREF = gi: 6462634 /DB_XREF = est: xj93f03.x1 /CLONE = IMAGE: 2664797 /UG = Hs.29352 tumor necrosis factor, alpha-induced protein 6 /FL = gb: NM_007115.1 | 206025_s_at |
| KIAA0960: KIAA0960 protein (LOC23249) | Consensus includes gb: BF447246 /FEA = EST | 213894_at |

TABLE 1-continued

VEGFR-2 Biomarkers

| Unigene title and SEQ ID NO: | Affymetrix Description | Affymetrix Probe Set |
|---|---|---|
| SEQ ID NOS: 43 (DNA) and 136 (amino acid) | /DB_XREF = gi: 11512384 /DB_XREF = est: 7p46g06.x1 /CLONE = IMAGE: 3648970 /UG = Hs.29900 KIAA0960 protein | |
| LAMA4: laminin, alpha 4 (LOC3910) SEQ ID NOS: 44 (DNA) and 137 (amino acid) | gb: NM_002290.2 /DEF = Homo sapiens laminin, alpha 4 (LAMA4), mRNA. /FEA = mRNA /GEN = LAMA4 /PROD = laminin, alpha 4 precursor /DB_XREF = gi: 9845494 /UG = Hs.78672 laminin, alpha 4 /FL = gb: NM_002290.2 | 202202_s_at |
| ENG: endoglin (Osler-Rendu-Weber syndrome 1) (LOC2022) SEQ ID NOS: 45 (DNA) and 138 (amino acid) | gb: NM_000118.1 /DEF = Homo sapiens endoglin (Osler-Rendu-Weber syndrome 1) (ENG), mRNA. /FEA = mRNA /GEN = ENG /PROD = endoglin precursor /DB_XREF = gi: 4557554 /UG = Hs.76753 endoglin (Osler-Rendu-Weber syndrome 1) /FL = gb: NM_000118.1 | 201809_s_at |
| CXCL6: chemokine (C-X-C motif) ligand 6 (granulocyte chemotactic protein 2) (LOC6372) SEQ ID NOS: 46 (DNA) and 139 (amino acid) | gb: NM_002993.1 /DEF = Homo sapiens small inducible cytokine subfamily B (Cys-X-Cys), member 6 (granulocyte chemotactic protein 2) (SCYB6), mRNA. /FEA = mRNA /GEN = SCYB6 /PROD = small inducible cytokine subfamily B(Cys-X-Cys), member 6 (granulocyte chemotactic protein 2) /DB_XREF = gi: 4506850 /UG = Hs.164021 small inducible cytokine subfamily B (Cys-X-Cys), member 6 (granulocyte chemotactic protein 2) /FL = gb: U81234.1 gb: NM_002993.1 | 206336_at |
| FLJ10134: hypothetical protein FLJ10134 (LOC55076) SEQ ID NOS: 47 (DNA) and 140 (amino acid) | gb: NM_018004.1 /DEF = Homo sapiens hypothetical protein FLJ10134 (FLJ10134), mRNA. /FEA = mRNA /GEN = FLJ10134 /PROD = hypothetical protein FLJ10134 /DB_XREF = gi: 8922242 /UG = Hs.104800 hypothetical protein FLJ10134 /FL = gb: NM_018004.1 | 219410_at |
| PPAP2B: phosphatidic acid phosphatase type 2B (LOC8613) SEQ ID NOS: 48 (DNA) and 141 (amino acid) | Consensus includes gb: AA628586 /FEA = EST /DB_XREF = gi: 2540973 /DB_XREF = est: af39f12.s1 /CLONE = IMAGE: 1034063 /UG = Hs.173717 Homo sapiens phosphatidic acid phosphatase type 2B (PPAP2B), mRNA | 212226_s_at |
| PPAP2A: phosphatidic acid phosphatase type 2A (LOC8611) SEQ ID NOS: 49 (DNA) and 142 (amino acid) | gb: AB000888.1 /DEF = Homo sapiens mRNA for phosphatidic acid phosphatase 2a, complete cds. /FEA = mRNA /PROD = phosphatidic acid phosphatase 2a /DB_XREF = gi: 2467297 /UG = Hs.41569 phosphatidic acid phosphatase type 2A /FL = gb: AB000888.1 gb: AF017116.1 gb: AF014402.1 gb: NM_003711.1 | 209147_s_at |
| HEG: HEG homolog (LOC57493) SEQ ID NOS: 50 (DNA) | Consensus includes gb: AI148659 /FEA = EST /DB_XREF = gi: 3677128 /DB_XREF = est: qc69c01.x1 /CLONE = IMAGE: 1714848 /UG = Hs.296326 ESTs | 213069_at |
| PTGS2: prostaglandin-endoperoxide synthase 2 (prostaglandin G/H synthase | gb: NM_000963.1 /DEF = Homo sapiens prostaglandin-endoperoxide synthase 2 | 204748_at |

TABLE 1-continued

VEGFR-2 Biomarkers

| Unigene title and SEQ ID NO: | Affymetrix Description | Affymetrix Probe Set |
|---|---|---|
| and cyclooxygenase) (LOC5743) SEQ ID NOS: 51 (DNA) and 143 (amino acid) | (prostaglandin GH synthase and cyclooxygenase) (PTGS2), mRNA. /FEA = mRNA /GEN = PTGS2 /PROD = prostaglandin-endoperoxide synthase 2(prostaglandin GH synthase and cyclooxygenase) /DB_XREF = gi: 4506264 /UG = Hs.196384 prostaglandin-endoperoxide synthase 2 (prostaglandin GH synthase and cyclooxygenase) /FL = gb: M90100.1 gb: L15326.1 gb: NM_000963.1 | |
| GPR116: G protein-coupled receptor 116 (LOC221395) SEQ ID NOS: 52 (DNA) and 144 (amino acid) | Consensus includes gb: N95226 /FEA = EST /DB_XREF = gi: 1267507 /DB_XREF = est: zb53f09.s1 /CLONE = IMAGE: 307337 /UG = Hs.22039 KIAA0758 protein | 212951_at |
| PPAP2B: phosphatidic acid phosphatase type 2B (LOC8613) SEQ ID NOS: 53 (DNA) and 145 (amino acid) | Consensus includes gb: AV725664 /FEA = EST /DB_XREF = gi: 10831279 /DB_XREF = est: AV725664 /CLONE = HTCAOD07 /UG = Hs.173717 Homo sapiens phosphatidic acid phosphatase type 2B (PPAP2B), mRNA | 212230_at |
| NR3C1: nuclear receptor subfamily 3, group C, member 1 (glucocorticoid receptor) (LOC2908) SEQ ID NOS: 54 (DNA) and 146 (amino acid) | gb: U01351.1 /DEF = Human glucocorticoid receptor alpha-2 mRNA, complete cds. /FEA = mRNA /PROD = glucocorticoid receptor alpha-2 /DB_XREF = gi: 458656 /FL = gb: U01351.1 | 211671_s_at |
| CSF3: colony stimulating factor 3 (granulocyte) (LOC1440) SEQ ID NOS: 55 (DNA) and 147 (amino acid) | gb: NM_000759.1 /DEF = *Homo sapiens* colony stimulating factor 3 (granulocyte) (CSF3), mRNA. /FEA = mRNA /GEN = CSF3 /PROD = colony stimulating factor 3 (granulocyte) /DB_XREF = gi: 4503078 /UG = Hs.2233 colony stimulating factor 3 (granulocyte) /FL = gb: M17706.1 gb: NM_000759.1 | 207442_at |
| PDE1A: phosphodiesterase 1A, calmodulin-dependent (LOC5136) SEQ ID NOS: 56 (DNA) and 148 (amino acid) | gb: NM_005019.1 /DEF = *Homo sapiens* phosphodiesterase 1A, calmodulin-dependent (PDE1A), mRNA. /FEA = mRNA /GEN = PDE1A /PROD = phosphodiesterase 1A, calmodulin-dependent /DB_XREF = gi: 4826891 /UG = Hs.41717 phosphodiesterase 1A, calmodulin-dependent /FL = gb: U40370.1 gb: NM_005019.1 | 208396_s_at |
| CPE: carboxypeptidase E (LOC1363) SEQ ID NOS: 57 (DNA) and 149 (amino acid) | Consensus includes gb: AI922855 /FEA = EST /DB_XREF = gi: 5658819 /DB_XREF = est: wo14h05.x1 /CLONE = IMAGE: 2455353 /UG = Hs.75360 carboxypeptidase E /FL = gb: NM_001873.1 | 201116_s_at |
| ENTPD1: ectonucleoside triphosphate diphosphohydrolase 1 (LOC953) SEQ ID NOS: 58 (DNA) and 150 (amino acid) | gb: NM_001776.1 /DEF = *Homo sapiens* ectonucleoside triphosphate diphosphohydrolase 1 (ENTPD1), mRNA. /FEA = mRNA /GEN = ENTPD1 /PROD = ectonucleoside triphosphate diphosphohydrolase1 /DB_XREF = gi: 4502666 /UG = Hs.205353 ectonucleoside triphosphate diphosphohydrolase 1 /FL = gb: NM_001776.1 | 207691_x_at |

TABLE 1-continued

VEGFR-2 Biomarkers

| Unigene title and SEQ ID NO: | Affymetrix Description | Affymetrix Probe Set |
|---|---|---|
| NID2: nidogen 2 (osteonidogen) (LOC22795) SEQ ID NOS: 59 (DNA) and 151 (amino acid) | gb: NM_007361.1 /DEF = *Homo sapiens* nidogen 2 (NID2), mRNA. /FEA = mRNA /GEN = NID2 /PROD = nidogen 2 /DB_XREF = gi: 6679055 /UG = Hs.82733 nidogen 2 /FL = gb: D86425.1 gb: NM_007361.1 | 204114_at |
| LOC221981: hypothetical protein LOC221981 (LOC221981) SEQ ID NOS: 60 (DNA) | Consensus includes gb: R33964 /FEA = EST /DB_XREF = gi: 789822 /DB_XREF = est: yh74c03.r1 /CLONE = IMAGE: 135460 /UG = Hs.288681 Homo sapiens cDNA FLJ11022 fis, clone PLACE1003771 | 214920_at |
| IGFBP7: insulin-like growth factor binding protein 7 (LOC3490) SEQ ID NOS: 61 (DNA) and 152 (amino acid) | gb: NM_001553.1 /DEF = *Homo sapiens* insulin-like growth factor binding protein 7 (IGFBP7), mRNA. /FEA = mRNA /GEN = IGFBP7 /PROD = insulin-like growth factor binding protein 7 /DB_XREF = gi: 4504618 /UG = Hs.119206 insulin-like growth factor binding protein 7 /FL = gb: L19182.1 gb: NM_001553.1 | 201163_s_at |
| CSRP2: cysteine and glycine-rich protein 2 (LOC1466) SEQ ID NOS: 62 (DNA) and 153 (amino acid) | gb: U46006.1 /DEF = Homo sapiens smooth muscle LIM protein (h-SmLIM) mRNA, complete cds. /FEA = mRNA /GEN = h-SmLIM /PROD = smooth muscle LIM protein /DB_XREF = gi: 1314358 /UG = Hs.10526 cysteine and glycine-rich protein 2 /FL = gb: U46006.1 | 211126_s_at |
| EBAF: endometrial bleeding associated factor (left-right determination, factor A; transforming growth factor beta superfamily) (LOC7044) SEQ ID NOS: 63 (DNA) and 154 (amino acid) | gb: NM_003240.1 /DEF = *Homo sapiens* endometrial bleeding associated factor (left-right determination, factor A; transforming growth factor beta superfamily) (EBAF), mRNA. /FEA = mRNA /GEN = EBAF /PROD = transforming growth factor, beta 4 /DB_XREF = gi: 4503440 /UG = Hs.25195 endometrial bleeding associated factor (left-right determination, factor A; transforming growth factor beta superfamily) /FL = gb: U81523.1 gb: NM_003240.1 gb: AF081513.1 | 206012_at |
| T1A-2: lung type-I cell membrane-associated glycoprotein (LOC10630) SEQ ID NOS: 64 (DNA) and 155 (amino acid) | Consensus includes gb: AU154455 /FEA = EST /DB_XREF = gi: 11015976 /DB_XREF = est: AU154455 /CLONE = NT2RP4001145 /UG = Hs.135150 lung type-I cell membrane-associated glycoprotein | 221898_at |
| GUCY1B3: guanylate cyclase 1, soluble, beta 3 (LOC2983) SEQ ID NOS: 65 (DNA) and 156 (amino acid) | Consensus includes gb: W93728 /FEA = EST /DB_XREF = gi: 1422918 /DB_XREF = est: zd96a11.s1 /CLONE = IMAGE: 357308 /UG = Hs.77890 guanylate cyclase 1, soluble, beta 3 /FL = gb: NM_000857.1 | 203817_at |
| FLJ46603: FLJ46603 protein (LOC374826) SEQ ID NOS: 66 (DNA) and 157 (amino acid) | Consensus includes gb: BF968134 /FEA = EST /DB_XREF = gi: 12335349 /DB_XREF = est: 602269121F1 /CLONE = IMAGE: 4357349 /UG = Hs.250723 FK506 binding protein 12-rapamycin associated protein 1 | 212509_s_at |

TABLE 1-continued

VEGFR-2 Biomarkers

| Unigene title and SEQ ID NO: | Affymetrix Description | Affymetrix Probe Set |
|---|---|---|
| TNFAIP6: tumor necrosis factor, alpha-induced protein 6 (LOC7130) SEQ ID NOS: 67 (DNA) and 158 (amino acid) | gb: NM_007115.1 /DEF = *Homo sapiens* tumor necrosis factor, alpha-induced protein 6 (TNFAIP6), mRNA. /FEA = mRNA /GEN = TNFAIP6 /PROD = tumor necrosis factor, alpha-induced protein 6 /DB_XREF = gi: 6005905 /UG = Hs.29352 tumor necrosis factor, alpha-induced protein 6 /FL = gb: NM_007115.1 | 206026_s_at |
| PIGB: phosphatidylinositol glycan, class B (LOC9488) SEQ ID NOS: 68 (DNA) and 159 (amino acid) | Consensus includes gb: AU144243 /FEA = EST /DB_XREF = gi: 11005764 /DB_XREF = est: AU144243 /CLONE = HEMBA1001328 /UG = Hs.247118 phosphatidylinositol glycan, class B | 214151_s_at |
| ENTPD1: ectonucleoside triphosphate diphosphohydrolase 1 (LOC953) SEQ ID NOS: 69 (DNA) and 160 (amino acid) | Consensus includes gb: AV717590 /FEA = EST /DB_XREF = gi: 10814742 /DB_XREF = est: AV717590 /CLONE = DCBCFE01 /UG = Hs.205353 ectonucleoside triphosphate diphosphohydrolase 1 /FL = gb: U87967.1 | 209473_at |
| LDB2: LIM domain binding 2 (LOC9079) SEQ ID NOS: 70 (DNA) and 161 (amino acid) | gb: NM_001290.1 /DEF = *Homo sapiens* LIM domain binding 2 (LDB2), mRNA. /FEA = mRNA /GEN = LDB2 /PROD = LIM domain binding 2 /DB_XREF = gi: 4504970 /UG = Hs.4980 LIM domain binding 2 /FL = gb: AF047337.1 gb: AF064492.1 gb: AF068651.1 gb: NM_001290.1 | 206481_s_at |
| SAMSN1: SAM domain, SH3 domain and nuclear localisation signals, 1 (LOC64092) SEQ ID NOS: 71 (DNA) and 162 (amino acid) | gb: NM_022136.1 /DEF = *Homo sapiens* SAM domain, SH3 domain and nuclear localisation signals, 1 (SAMSN1), mRNA. /FEA = mRNA /GEN = SAMSN1 /PROD = SAM domain, SH3 domain and nuclear localisationsignals, 1 /DB_XREF = gi: 11545870 /UG = Hs.24633 SAM domain, SH3 domain and nuclear localisation signals, 1 /FL = gb: AF222927.1 gb: NM_022136.1 | 220330_s_at |
| CLDN5: claudin 5 (transmembrane protein deleted in velocardiofacial syndrome) (LOC7122) SEQ ID NOS: 72 (DNA) and 163 (amino acid) | gb: NM_003277.1 /DEF = *Homo sapiens* claudin 5 (transmembrane protein deleted in velocardiofacial syndrome) (CLDN5), mRNA. /FEA = mRNA /GEN = CLDN5 /PROD = transmembrane protein claudin 5 /DB_XREF = gi: 4502878 /UG = Hs.110903 claudin 5 (transmembrane protein deleted in velocardiofacial syndrome) /FL = gb: BC002404.1 gb: AF000959.1 gb: NM_003277.1 | 204482_at |
| CAV1: caveolin 1, caveolae protein, 22 kDa (LOC857) SEQ ID NOS: 73 (DNA) and 164 (amino acid) | gb: NM_001753.2 /DEF = *Homo sapiens* caveolin 1, caveolae protein, 22 kD (CAV1), mRNA. /FEA = mRNA /GEN = CAV1 /PROD = caveolin 1 /DB_XREF = gi: 4580417 /UG = Hs.323469 caveolin 1, caveolae protein, 22 kD /FL = gb: NM_001753.2 | 203065_s_at |
| PKIG: protein kinase (cAMP-dependent, catalytic) inhibitor gamma (LOC11142) | gb: NM_007066.1 /DEF = *Homo sapiens* protein kinase (cAMP-dependent, catalytic) inhibitor gamma (PKIG), mRNA. | 202732_at |

TABLE 1-continued

VEGFR-2 Biomarkers

| Unigene title and SEQ ID NO: | Affymetrix Description | Affymetrix Probe Set |
|---|---|---|
| SEQ ID NOS: 74 (DNA) and 165 (amino acid) | /FEA = mRNA /GEN = PKIG /PROD = protein kinase (cAMP-dependent, catalytic)inhibitor gamma /DB_XREF = gi: 5902019 /UG = Hs.3407 protein kinase (cAMP-dependent, catalytic) inhibitor gamma /FL = gb: AB019517.1 gb: AF182032.1 gb: NM_007066.1 | |
| COL4A2: collagen, type IV, alpha 2 (LOC1284) SEQ ID NOS: 75 (DNA) and 166 (amino acid) | Consensus includes gb: X05610.1 /DEF = Human mRNA for type IV collagen alpha (2) chain. /FEA = mRNA /PROD = alpha (2) chain /DB_XREF = gi: 29550 /UG = Hs.75617 collagen, type IV, alpha 2 | 211964_at |
| S100A8: S100 calcium binding protein A8 (calgranulin A) (LOC6279) SEQ ID NOS: 76 (DNA) and 167 (amino acid) | gb: NM_002964.2 /DEF = Homo sapiens S100 calcium-binding protein A8 (calgranulin A) (S100A8), mRNA. /FEA = mRNA /GEN = S100A8 /PROD = S100 calcium-binding protein A8 /DB_XREF = gi: 9845519 /UG = Hs.100000 S100 calcium-binding protein A8 (calgranulin A) /FL = gb: NM_002964.2 | 202917_s_at |
| MGC5618: hypothetical protein MGC5618 (LOC79099) SEQ ID NOS: 77 (DNA) | Consensus includes gb: BF575213 /FEA = EST /DB_XREF = gi: 11648925 /DB_XREF = est: 602133624F1 /CLONE = IMAGE: 4288756 /UG = Hs.177781 Homo sapiens, clone MGC: 5618, mRNA, complete cds /FL = gb: BC001980.1 | 221477_s_at |
| PRG1: proteoglycan 1, secretory granule (LOC5552) SEQ ID NOS: 78 (DNA) and 168 (amino acid) | gb: J03223.1 /DEF = Human secretory granule proteoglycan peptide core mRNA, complete cds. /FEA = mRNA /GEN = PRG1 /DB_XREF = gi: 190419 /UG = Hs.1908 proteoglycan 1, secretory granule /FL = gb: J03223.1 gb: NM_002727.1 | 201858_s_at |
| SCHIP1: schwannomin interacting protein 1 (LOC29970) SEQ ID NOS: 79 (DNA) and 169 (amino acid) | gb: NM_014575.1 /DEF = Homo sapiens schwannomin interacting protein 1 (SCHIP-1), mRNA. /FEA = mRNA /GEN = SCHIP-1 /PROD = schwannomin interacting protein 1 /DB_XREF = gi: 7657539 /UG = Hs.61490 schwannomin interacting protein 1 /FL = gb: AF145713.1 gb: NM_014575.1 | 204030_s_at |
| PRG1: proteoglycan 1, secretory granule (LOC5552) SEQ ID NOS: 80 (DNA) and 170 (amino acid) | gb: NM_002727.1 /DEF = Homo sapiens proteoglycan 1, secretory granule (PRG1), mRNA. /FEA = mRNA /GEN = PRG1 /PROD = proteoglycan 1, secretory granule /DB_XREF = gi: 4506044 /UG = Hs.1908 proteoglycan 1, secretory granule /FL = gb: J03223.1 gb: NM_002727.1 | 201859_at |
| MSN: moesin (LOC4478) SEQ ID NOS: 81 (DNA) and 171 (amino acid) | gb: NM_002444.1 /DEF = Homo sapiens moesin (MSN), mRNA. /FEA = mRNA /GEN = MSN /PROD = moesin /DB_XREF = gi: 4505256 /UG = Hs.170328 moesin /FL = gb: M69066.1 gb: NM_002444.1 | 200600_at |
| NR3C1: nuclear receptor subfamily 3, group C, member 1 (glucocorticoid receptor) (LOC2908) | Consensus includes gb: AI432196 /FEA = EST /DB_XREF = gi: 4308490 /DB_XREF = est: tg77g05.x1 | 201865_x_at |

TABLE 1-continued

VEGFR-2 Biomarkers

| Unigene title and SEQ ID NO: | Affymetrix Description | Affymetrix Probe Set |
|---|---|---|
| SEQ ID NOS: 82 (DNA) and 172 (amino acid) | /CLONE = IMAGE: 2114840 /UG = Hs.75772 nuclear receptor subfamily 3, group C, member 1 /FL = gb: M10901.1 gb: NM_000176.1 | |
| BCL6: B-cell CLL/lymphoma 6 (zinc finger protein 51) (LOC604) SEQ ID NOS: 83 (DNA) and 173 (amino acid) | gb: NM_001706.1 /DEF = *Homo sapiens* B-cell CLLlymphoma 6 (zinc finger protein 51) (BCL6), mRNA. /FEA = mRNA /GEN = BCL6 /PROD = B-cell CLLlymphoma 6 (zinc finger protein 51) /DB_XREF = gi: 4502382 /UG = Hs.155024 B-cell CLLlymphoma 6 (zinc finger protein 51) /FL = gb: U00115.1 gb: NM_001706.1 | 203140_at |
| HLX1: H2.0-like homeo box 1 (Drosophila) (LOC3142) SEQ ID NOS: 84 (DNA) and 174 (amino acid) | Consensus includes gb: M60721.1 /DEF = Human homeobox gene, complete cds. /FEA = mRNA /DB_XREF = gi: 183789 /UG = Hs.74870 H2.0 (Drosophila)-like homeo box 1 /FL = gb: NM_021958.1 gb: M60721.1 | 214438_at |
| CALD1: caldesmon 1 (LOC800) SEQ ID NOS: 85 (DNA) and 175 (amino acid) | Consensus includes gb: AL583520 /FEA = EST /DB_XREF = gi: 12952562 /DB_XREF = est: AL583520 /CLONE = CS0DC024YE13 (5 prime) /UG = Hs.182183 Homo *sapiens* mRNA for caldesmon, 3 UTR | 212077_at |
| PLEKHC1: pleckstrin homology domain containing, family C (with FERM domain) member 1 (LOC10979) SEQ ID NOS: 86 (DNA) and 176 (amino acid) | Consensus includes gb: AI928241 /FEA = EST /DB_XREF = gi: 5664205 /DB_XREF = est: wo95g11.x1 /CLONE = IMAGE: 2463140 /UG = Hs.75260 mitogen inducible 2 | 214212_x_at |
| SYNCOILIN: intermediate filament protein syncoilin (LOC81493) SEQ ID NOS: 87 (DNA) and 177 (amino acid) | gb: NM_030786.1 /DEF = *Homo sapiens* intermediate filament protein syncoilin (SYNCOILIN), mRNA. /FEA = mRNA /GEN = SYNCOILIN /PROD = intermediate filament protein syncoilin /DB_XREF = gi: 13540560 /FL = gb: NM_030786.1 | 221276_s_at |
| NID: nidogen (enactin) (LOC4811) SEQ ID NOS: 88 (DNA) and 178 (amino acid) | Consensus includes gb: BF940043 /FEA = EST /DB_XREF = gi: 12357363 /DB_XREF = est: nac66f12.x1 /CLONE = IMAGE: 3439271 /UG = Hs.62041 nidogen (enactin) /FL = gb: M30269.1 gb: NM_002508.1 | 202007_at |

TABLE 1-continued

VEGFR-2 Biomarkers

| Unigene title and SEQ ID NO: | Affymetrix Description | Affymetrix Probe Set |
|---|---|---|
| FCGR3A: Fc fragment of IgG, low affinity IIIa, receptor for (CD16) (LOC2214)<br>SEQ ID NOS: 89 (DNA) and 179 (amino acid) | gb: J04162.1 /DEF = Human leukocyte IgG receptor (Fc-gamma-R) mRNA, complete cds. /FEA = mRNA /DB_XREF = gi: 183036 /UG = Hs.176663 Fc fragment of IgG, low affinity IIIb, receptor for (CD16) /FL = gb: NM_000570.1 gb: J04162.1 gb: M24854.1 gb: AB025256.1 | 204007_at |
| TCF4: transcription factor 4 (LOC6925)<br>SEQ ID NOS: 90 (DNA) and 180 (amino acid) | Consensus includes gb: AI927067 /FEA = EST /DB_XREF = gi: 5663031 /DB_XREF = est: wo87f01.x1 /CLONE = IMAGE: 2462329 /UG = Hs.289068 Homo sapiens cDNA FLJ11918 fis, clone HEMBB1000272 | 213891_s_at |
| TFPI2: tissue factor pathway inhibitor 2 (LOC7980)<br>SEQ ID NOS: 91 (DNA) and 181 (amino acid) | Consensus includes gb: AL574096 /FEA = EST /DB_XREF = gi: 12933969 /DB_XREF = est: AL574096 /CLONE = CS0DI040YI17 (3 prime) /UG = Hs.295944 tissue factor pathway inhibitor 2 /FL = gb: BC005330.1 gb: L27624.1 gb: D29992.1 gb: NM_006528.1 | 209277_at |
| TIE: tyrosine kinase with immunoglobulin and epidermal growth factor homology domains (LOC7075)<br>SEQ ID NOS: 92 (DNA) and 182 (amino acid) | gb: NM_005424.1 /DEF = *Homo sapiens* tyrosine kinase with immunoglobulin and epidermal growth factor homology domains (TIE), mRNA. /FEA = mRNA /GEN = TIE /PROD = tyrosine kinase with immunoglobulin andepidermal growth factor homology domains /DB_XREF = gi: 4885630 /UG = Hs.78824 tyrosine kinase with immunoglobulin and epidermal growth factor homology domains /FL = gb: NM_005424.1 | 204468_s_at |
| ANGPT2: angiopoietin 2 (LOC285)<br>SEQ ID NOS: 93 (DNA) and 183 (amino acid) | gb: NM_001147.1 /DEF = *Homo sapiens* angiopoietin 2 (ANGPT2), mRNA. /FEA = mRNA /GEN = ANGPT2 /PROD = angiopoietin 2 /DB_XREF = gi: 4557314 /UG = Hs.115181 angiopoietin 2 /FL = gb: AF004327.1 gb: NM_001147.1 gb: AB009865.1 | 205572_at |
| OAZ2: ornithine decarboxylase antizyme 2 (LOC4947)<br>SEQ ID NOS: 94 (DNA) and 184 (amino acid) | gb: AF242521.1 /DEF = *Homo sapiens* ornithine decarboxylase antizyme mRNA, complete cds. /FEA = mRNA /PROD = ornithine decarboxylase antizyme /DB_XREF = gi: 9802039 /UG = Hs.74563 ornithine decarboxylase antizyme 2 /FL = gb: AF057297.1 gb: AF242521.1 gb: NM_002537.1 | 201364_s_at |

The biomarkers listed in Table 1 are strongly co-expressed with VEGFR-2 in tumor gene expression profiles. The biomarkers serve as useful molecular tools for predicting and monitoring response to VEGFR-2 modulators that affect VEGFR-2 activity or the VEGFR-2 signal transduction pathway.

The biomarkers listed in Table 2 are a subset of the markers listed in Table 1 and were identified as being significantly modulated by treatment with the "example VEGFR-2 modulator" as defined in the Examples.

TABLE 2

VEGFR-2 Co-Expressed Biomarkers Identified to be Modulated by Treatment with the Example VEGFR-2 Inhibitor

| Rank | human U133A probe_ID | human NM_ID; Hs_ID; giID human Hs_ID human gi_ID | Human Gene (symbol) | mouse homolog 430A Probe_ID | mouse NM_ID; Mm_ID; mouse gi_ID | Mouse Gene (symbol) | t-test (P < 0.05) | fold-change | down = decrease mRNA levels; no-change = no increase or decrease mRNA levels; increase = increase mRNA levels |
|---|---|---|---|---|---|---|---|---|---|
| 1 | 202878_s_at | NM_012072; Hs.97199; gi:11496985 | complement component C1q receptor (C1QR1) | 1419589_at | NM_010740; Mm.681; gi:6754577 | (Ly68) complement component 1, q subcomponent, receptor 1 (C1qr1) | 0.000005 | 5 | down |
| 2 | 211980_at | NM_001845; Hs.119129; gi:5658569 | collagen, type IV, alpha 1 (COL4A1) | 1427986_a_at | unknown; Mm.738; gi:7179107 | procollagen, type IV, alpha 1 (Col4a1) | 0.000014 | 4 | down |
| 3 | 211980_at | NM_001845; Hs.119129; gi:5658569 | collagen, type IV, alpha 1 (COL4A1) | 1452035_at | unknown; Mm.738; gi:11038725 | procollagen, type IV, alpha 1 (Col4a1) | 0.000018 | 6 | down |
| 4 | 203065_s_at | NM_001753; Hs.323469; gi:4580417 | caveolin 1 (CAV1) | 1449145_a_at | NM_007616; Mm.28278; gi:6705976 | caveolin, caveolae protein 1 (Cav1) | 2.72030E-04 | 1 | no change |
| 5 | 213592_at | NM_005161; Hs.9305; gi:6911643 | angiotensin receptor-like 1 (AGTRL1) | 1423037_at | NM_011784; Mm.29368; gi:16446226 | angiotensin receptor-like 1 (Agtrl1) | 5.54812E-04 | 4 | down |
| 6 | 204468_s_at | NM_005424; Hs.78824; gi:4885630 | (TIE) tyrosine kinase with immuno-globulin and epidermal growth factor homology (TIE) | 1416238_at | NM_011587; Mm.4345; gi:6755784 | (Tie1) tyrosine kinase receptor 1 (Tie1) | 0.00103262 | 11 | down |
| 7 | 204677_at | NM_001795; Hs.76206; gi:4502726 | VE-cadherin (CDH5) | 1433956_at | unknown; Mm.135114; gi:7186115 | VE-Cadherin (Cdh5) | 0.001154369 | 2 | down |
| 8 | 204115_at | NM_004126; Hs.83381; gi:4758447 | guanine nucleotide binding protein 11 (GNG11) | 1448942_at | NM_025331; Mm.25547; gi:13384697 | guanine nucleotide binding protein (G protein), gamma 11 (Gng11) | 0.001326667 | 2 | down |
| 9 | 204345_at | NM_001856; Hs.26208; gi:11386158 | collagen, type XVI, alpha 1 (COL16A1) | 1427986_a_at | unknown; Mm.41860; gi:16194279 | procollagen, type XVI, alpha 1 (Col16a1) | 0.014896833 | 1 | no change |
| 10 | 219134_at | NM_022159; Hs.57958; gi:11545907 | EGF-TM7-latrophilin-related protein (ELTD1) | 1418059_at | NM_133222; Mm.27242; gi:16877797 | EGF, latrophilin seven trans-membrane domain containing 1 (Eltd1) | 0.018655985 | 2 | down |
| 11 | 201809_s_at | NM_000118; Hs.76753; gi:4557554 | endoglin (ENG) | 1417271_a_at | NM_007932; Mm.4851; gi:6679648 | endoglin (Eng) | 0.021873085 | 2 | down |
| 12 | 204114_at | NM_007361; Hs.82733; gi:6679055 | nidogen 2 (NID2) | 1423516_a_at | NM_134085; Mm.20348; gi:16942135 | nidogen 2 (Nid2) | 0.024126268 | 3 | down |
| 13 | 208396_s_at | NM_005019; Hs.41717; gi:4826891 | phospho-diesterase 1A, calmodulin-dependent (PDE1A) | 1449298_a_at | NM_016744; Mm.40678; gi:7949106 | phospho-diesterase 1A, calmodulin-dependent (Pde1a) | 0.025570996 | 1 | no change |

TABLE 2-continued

VEGFR-2 Co-Expressed Biomarkers Identified to be Modulated by Treatment with the Example VEGFR-2 Inhibitor

| Rank | human U133A probe_ID | human NM_ID; Hs_ID; giID human Hs_ID human gi_ID | Human Gene (symbol) | mouse homolog 430A Probe_ID | mouse NM_ID; mouse Mm_ID; mouse gi_ID | Mouse Gene (symbol) | t-test (P < 0.05) | fold-change | down = decrease mRNA levels; no-change = no increase or decrease mRNA levels; increase = increase mRNA levels |
|---|---|---|---|---|---|---|---|---|---|
| 14 | 213592_at | NM_005161; Hs.9305; gi:6911643 | angiotensin receptor-like 1 (AGTRL1) | 1438651_a_at | NM_011784; Mm.29368; gi:9400966 | angiotensin receptor-like 1 (Agtrl1) | 0.026038828 | 2 | down |
| 15 | 208396_s_at | NM_007066; Hs.3407; gi:5902019 | protein kinase (cAMP-dependent, catalytic) inhibitor (PKIG) | 1434820_s_at | unknown; Mm.10091; gi:6150557 | protein kinase inhibitor, gamma (Pkig) | 0.032286798 | 1 | no change |
| 16 | 201859_at | NM_002727; Hs.1908; gi:4506044 | proteoglycan 1, secretory granule (PRG1) | 1417426_at | NM_011157; Mm.22194; gi:6997242 | proteoglycan 1, secretory granule (Prg1) | 0.034821585 | 2 | increase |
| 17 | 202917_s_at | NM_002964; Hs.100000; gi:9845519 | S100 calcium binding protein A8 (S100A8) | 1419394_s_at | NM_013650; Mm.21567; gi:7305452 | S100 calcium binding protein A8 (calgranulin A) (S100a8) | 0.040857487 | 1 | no change |
| 18 | 206702_at | NM_000459; Hs.89640; gi:4557868 | TEK tyrosine kinase, endothelial (TEK) | 1418788_at | NM_013690; Mm.14313; gi:8567411 | (tek) endothelial-specific receptor tyrosine kinase (Tek) | 0.047098006 | 1 | no change |

VEGFR-2 Modulators:

As used herein, the term "VEGFR-2 modulator" is intended to mean a compound or drug that is a biological molecule or a small molecule that directly or indirectly modulates VEGFR-2 activity or the VEGFR-2 signal transduction pathway. Thus, compounds or drugs as used herein is intended to include both small molecules and biological molecules. Direct or indirect modulation includes activation or inhibition of VEGFR-2 activity or the VEGFR-2 signal transduction pathway. In one aspect, inhibition refers to inhibition of the binding of VEGFR-2 to an VEGFR-2 ligand such as, for example, VEGF. In another aspect, inhibition refers to inhibition of the kinase activity of VEGFR-2.

VEGFR-2 modulators include, for example, VEGFR-2 specific ligands, small molecule VEGFR-2 inhibitors, and VEGFR-2 monoclonal antibodies. In one aspect, the VEGFR-2 modulator inhibits VEGFR-2 activity and/or inhibits the VEGFR-2 signal transduction pathway. In another aspect, the VEGFR-2 modulator is an VEGFR-2 monoclonal antibody that inhibits VEGFR-2 activity and/or inhibits the VEGFR-2 signal transduction pathway.

VEGFR-2 modulators include biological molecules or small molecules.

Biological molecules include all lipids and polymers of monosaccharides, amino acids, and nucleotides having a molecular weight greater than 450. Thus, biological molecules include, for example, oligosaccharides and polysaccharides; oligopeptides, polypeptides, peptides, and proteins; and oligonucleotides and polynucleotides. Oligonucleotides and polynucleotides include, for example, DNA and RNA.

Biological molecules further include derivatives of any of the molecules described above. For example, derivatives of biological molecules include lipid and glycosylation derivatives of oligopeptides, polypeptides, peptides, and proteins.

Derivatives of biological molecules further include lipid derivatives of oligosaccharides and polysaccharides, e.g., lipopolysaccharides. Most typically, biological molecules are antibodies, or functional equivalents of antibodies. Functional equivalents of antibodies have binding characteristics comparable to those of antibodies, and inhibit the growth of cells that express VEGFR-2. Such functional equivalents include, for example, chimerized, humanized, and single chain antibodies as well as fragments thereof.

Functional equivalents of antibodies also include polypeptides with amino acid sequences substantially the same as the amino acid sequence of the variable or hypervariable regions of the antibodies. An amino acid sequence that is substantially the same as another sequence, but that differs from the other sequence by means of one or more substitutions, additions, and/or deletions, is considered to be an equivalent sequence. Preferably, less than 50%, more preferably less than 25%, and still more preferably less than 10%, of the number of amino acid residues in a sequence are substituted for, added to, or deleted from the protein.

The functional equivalent of an antibody is preferably a chimerized or humanized antibody. A chimerized antibody comprises the variable region of a non-human antibody and the constant region of a human antibody. A humanized antibody comprises the hypervariable region (CDRs) of a non-human antibody. The variable region other than the hypervariable region, e.g., the framework variable region, and the constant region of a humanized antibody are those of a human antibody.

Suitable variable and hypervariable regions of non-human antibodies may be derived from antibodies produced by any non-human mammal in which monoclonal antibodies are made. Suitable examples of mammals other than humans include, for example, rabbits, rats, mice, horses, goats, or primates.

Functional equivalents further include fragments of antibodies that have binding characteristics that are the same as, or are comparable to, those of the whole antibody. Suitable fragments of the antibody include any fragment that comprises a sufficient portion of the hypervariable (i.e., complementarity determining) region to bind specifically, and with sufficient affinity, to VEGFR-2 tyrosine kinase to inhibit growth of cells that express such receptors.

Such fragments may, for example, contain one or both Fab fragments or the F(ab')2 fragment. Preferably, the antibody fragments contain all six complementarity determining regions of the whole antibody, although functional fragments containing fewer than all of such regions, such as three, four, or five CDRs, are also included.

In one aspect, the fragments are single chain antibodies, or Fv fragments. Single chain antibodies are polypeptides that comprise at least the variable region of the heavy chain of the antibody linked to the variable region of the light chain, with or without an interconnecting linker. Thus, Fv fragment comprises the entire antibody combining site. These chains may be produced in bacteria or in eukaryotic cells.

The antibodies and functional equivalents may be members of any class of immunoglobulins, such as IgG, IgM, IgA, IgD, or IgE, and the subclasses thereof.

In one aspect, the antibodies are members of the IgG1 subclass. The functional equivalents may also be equivalents of combinations of any of the above classes and subclasses.

In one aspect, the VEGFR-2 antibody is CDP-791 (UCB). In another aspect, the VEGFR-2 antibody is IMC-1121b (ImClone Systems). In yet another aspect, the VEGFR-2 modulator is AVE-005 (VEGF trap, Regeneron Pharmaceuticals).

In addition to the biological molecules discussed above, the VEGFR-2 modulators useful in the invention may also be small molecules. Any molecule that is not a biological molecule is considered herein to be a small molecule. Some examples of small molecules include organic compounds, organometallic compounds, salts of organic and organometallic compounds, saccharides, amino acids, and nucleotides. Small molecules further include molecules that would otherwise be considered biological molecules, except their molecular weight is not greater than 450. Thus, small molecules may be lipids, oligosaccharides, oligopeptides, and oligonucleotides and their derivatives, having a molecular weight of 450 or less.

It is emphasized that small molecules can have any molecular weight. They are merely called small molecules because they typically have molecular weights less than 450. Small molecules include compounds that are found in nature as well as synthetic compounds. In one embodiment, the VEGFR-2 modulator is a small molecule that inhibits the growth of tumor cells that express VEGFR-2. In another embodiment, the VEGFR-2 modulator is a small molecule that inhibits the growth of refractory tumor cells that express VEGFR-2.

Numerous small molecules have been described as being useful to inhibit VEGFR-2.

In one aspect, the VEGFR-2 modulator is [(1R),2S]-2-Aminopropionic acid 2-[4-(4-fluoro-2-methyl-1H-indol-5-yloxy)-5-methylpyrrolo[2,1-f][1,2,4]triazin-6-yloxy]-1-methylethyl ester having the structure:

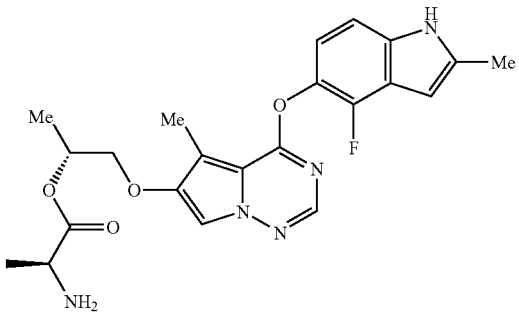

In another aspect, the VEGFR-2 modulator is selected from the compounds described in U.S. Pat. No. 6,869,952, hereby incorporated by reference. In yet another aspect, the VEGFR-2 modulator is selected from the compounds described in PCT Publication No. WO00/71129 or WO2004/009601, hereby incorporated by reference.

In another aspect, the VEGFR-2 modulator is selected from CHIR-258 (Chiron), AZD-2171 (AstraZeneca), GW786034 (GlaxoSmithKline), AMG 706 (Amgen), BIBF 1120 (Boehringer Ingelheim), AE788 (Novartis), ZD6474 (AstraZeneca), BAY 43-9006 (Sorafenib, Bayer), and SU11248 (Sutent, Pfizer).

Biomarkers and Biomarker Sets:

The invention includes individual biomarkers and biomarker sets having both diagnostic and prognostic value in disease areas in which signaling through VEGFR-2 or the VEGFR-2 pathway is of importance, e.g., in cancers or tumors, in immunological disorders, conditions or dysfunctions, or in disease states in which cell signaling and/or cellular proliferation controls are abnormal or aberrant. The biomarker sets comprise a plurality of biomarkers such as, for example, a plurality of the biomarkers provided in Table 1 that highly correlate with resistance or sensitivity to one or more VEGFR-2 modulators.

The biomarkers and biomarker sets of the invention enable one to predict or reasonably foretell the likely effect of one or more VEGFR-2 modulators in different biological systems or for cellular responses. The biomarkers and biomarker sets can be used in in vitro assays of VEGFR-2 modulator response by test cells to predict in vivo outcome. In accordance with the invention, the various biomarkers and biomarker sets described herein, or the combination of these biomarker sets with other biomarkers or markers, can be used, for example, to predict and monitor how patients with cancer might respond to therapeutic intervention with one or more VEGFR-2 modulators.

A biomarker and biomarker set of cellular gene expression patterns correlating with sensitivity or resistance of cells following exposure of the cells to one or more VEGFR-2 modulators provides a useful tool for screening one or more tumor samples before treatment with the VEGFR-2 modulator. The screening allows a prediction of cells of a tumor sample exposed to one or more VEGFR-2 modulators, based on the expression results of the biomarker and biomarker set, as to whether or not the tumor, and hence a patient harboring the tumor, will or will not respond to treatment with the VEGFR-2 modulator.

The biomarker or biomarker set can also be used as described herein for monitoring the progress of disease treatment or therapy in those patients undergoing treatment for a disease involving an VEGFR-2 modulator.

The biomarkers also serve as targets for the development of therapies for disease treatment. Such targets may be particularly applicable to treatment of cancer, such as, for example, hepatocellular carcinoma, colorectal cancer (CRC), NSCLC, and metastatic breast cancer.

Indeed, because these biomarkers are differentially expressed in sensitive and resistant cells, their expression patterns are correlated with relative intrinsic sensitivity of cells to treatment with VEGFR-2 modulators. Accordingly, the biomarkers highly expressed in resistant cells may serve as targets for the development of new therapies for the tumors which are resistant to VEGFR-2 modulators, particularly VEGFR-2 inhibitors. The level of biomarker protein and/or mRNA can be determined using methods well known to those skilled in the art. For example, quantification of protein can be carried out using methods such as ELISA, 2-dimensional SDS PAGE, Western blot, immunoprecipitation, immunohistochemistry, fluorescence activated cell sorting (FACS), or flow cytometry. Quantification of mRNA can be carried out using methods such as PCR, array hybridization, Northern blot, in-situ hybridization, dot-blot, Taqman, or RNAse protection assay.

Microarrays:

The invention also includes specialized microarrays, e.g., oligonucleotide microarrays or cDNA microarrays, comprising one or more biomarkers, showing expression profiles that correlate with either sensitivity or resistance to one or more VEGFR-2 modulators. Such microarrays can be employed in in vitro assays for assessing the expression level of the biomarkers in the test cells from tumor biopsies, and determining whether these test cells are likely to be resistant or sensitive to VEGFR-2 modulators. For example, a specialized microarray can be prepared using all the biomarkers, or subsets thereof, as described herein and shown in Table 1. Cells from a tissue or organ biopsy can be isolated and exposed to one or more of the VEGFR-2 modulators. In one aspect, following application of nucleic acids isolated from both untreated and treated cells to one or more of the specialized microarrays, the pattern of gene expression of the tested cells can be determined and compared with that of the biomarker pattern from the control panel of cells used to create the biomarker set on the microarray. Based upon the gene expression pattern results from the cells that underwent testing, it can be determined if the cells show a resistant or a sensitive profile of gene expression. Whether or not the tested cells from a tissue or organ biopsy will respond to one or more of the VEGFR-2 modulators and the course of treatment or therapy can then be determined or evaluated based on the information gleaned from the results of the specialized microarray analysis.

Antibodies:

The invention also includes antibodies, including polyclonal or monoclonal, directed against one or more of the polypeptide biomarkers. Such antibodies can be used in a variety of ways, for example, to purify, detect, and target the biomarkers of the invention, including both in vitro and in vivo diagnostic, detection, screening, and/or therapeutic methods.

Kits:

The invention also includes kits for determining or predicting whether a patient would be susceptible or resistant to a treatment that comprises one or more VEGFR-2 modulators. The patient may have a cancer or tumor such as, for example, a breast cancer or tumor. Such kits would be useful in a clinical setting for use in testing a patient's biopsied tumor or cancer samples, for example, to determine or predict if the patient's tumor or cancer will be resistant or sensitive to a given treatment or therapy with an VEGFR-2 modulator. The kit comprises a suitable container that comprises: one or more microarrays, e.g., oligonucleotide microarrays or cDNA microarrays, that comprise those biomarkers that correlate with resistance and sensitivity to VEGFR-2 modulators, particularly VEGFR-2 inhibitors; one or more VEGFR-2 modulators for use in testing cells from patient tissue specimens or patient samples; and instructions for use. In addition, kits contemplated by the invention can further include, for example, reagents or materials for monitoring the expression of biomarkers of the invention at the level of mRNA or protein, using other techniques and systems practiced in the art such as, for example, RT-PCR assays, which employ primers designed on the basis of one or more of the biomarkers described herein, immunoassays, such as enzyme linked immunosorbent assays (ELISAs), immunoblotting, e.g., Western blots, or in situ hybridization, and the like, as further described herein.

Application of Biomarkers and Biomarker Sets:

The biomarkers and biomarker sets may be used in different applications. Biomarker sets can be built from any combination of biomarkers listed in Tables 1 and 2 to make predictions about the likely effect of any VEGFR-2 modulator in different biological systems. The various biomarkers and biomarkers sets described herein can be used, for example, as diagnostic or prognostic indicators in disease management, to predict how patients with cancer might respond to therapeutic intervention with compounds that modulate the VEGFR-2, and to predict how patients might respond to therapeutic intervention that modulates signaling through the entire VEGFR-2 regulatory pathway.

While the data described herein were generated in cell lines that are routinely used to screen and identify compounds that have potential utility for cancer therapy, the biomarkers have both diagnostic and prognostic value in other diseases areas in which signaling through VEGFR-2 or the VEGFR-2 pathway is of importance, e.g., in immunology, or in cancers or tumors in which cell signaling and/or proliferation controls have gone awry.

In accordance with the invention, cells from a patient tissue sample, e.g., a tumor or cancer biopsy, can be assayed to determine the expression pattern of one or more biomarkers prior to treatment with one or more VEGFR-2 modulators. Success or failure of a treatment can be determined based on the biomarker expression pattern of the cells from the test tissue (test cells), e.g., tumor or cancer biopsy, as being relatively similar or different from the expression pattern of a control set of the one or more biomarkers. Thus, if the test cells show a biomarker expression profile which corresponds to that of the biomarkers in the control panel of cells which are sensitive to the VEGFR-2 modulator, it is highly likely or predicted that the individual's cancer or tumor will respond favorably to treatment with the VEGFR-2 modulator. By contrast, if the test cells show a biomarker expression pattern corresponding to that of the biomarkers of the control panel of cells which are resistant to the VEGFR-2 modulator, it is highly likely or predicted that the individual's cancer or tumor will not respond to treatment with the VEGFR-2 modulator.

The invention also provides a method of monitoring the treatment of a patient having a disease treatable by one or more VEGFR-2 modulators. The isolated test cells from the patient's tissue sample, e.g., a tumor biopsy or blood sample, can be assayed to determine the expression pattern of one or more biomarkers before and after exposure to an VEGFR-2 modulator wherein, preferably, the VEGFR-2 modulator is an VEGFR-2 inhibitor. The resulting biomarker expression profile of the test cells before and after treatment is compared with that of one or more biomarkers as described and shown herein to be highly expressed in the control panel of cells that are either resistant or sensitive to an VEGFR-2 modulator. Thus, if a patient's response is sensitive to treatment by an VEGFR-2 modulator, based on correlation of the expression profile of the one or biomarkers, the patient's treatment prognosis can be qualified as favorable and treatment can continue. Also, if, after treatment with an VEGFR-2 modulator, the test cells don't show a change in the biomarker expression profile corresponding to the control panel of cells that are sensitive to the VEGFR-2 modulator, it can serve as an indicator that the current treatment should be modified, changed, or even discontinued. This monitoring process can indicate success or failure of a patient's treatment with an VEGFR-2 modulator and such monitoring processes can be repeated as necessary or desired.

The biomarkers of the invention can be used to predict an outcome prior to having any knowledge about a biological system. Essentially, a biomarker can be considered to be a statistical tool. Biomarkers are useful primarily in predicting the phenotype that is used to classify the biological system. In an embodiment of the invention, the goal of the prediction is to classify cancer cells as having an active or inactive VEGFR-2 pathway. Cancer cells with an inactive VEGFR-2 pathway can be considered resistant to treatment with an VEGFR-2 modulator.

EXAMPLES

Methods and Samples

In the following examples, the compound [(1R),2S]-2-Aminopropionic acid 2-[4-(4-fluoro-2-methyl-1H-indol-5-yloxy)-5-methylpyrrolo[2,1-f][1,2,4]triazin-6-yloxy]-1-methylethyl ester was used:

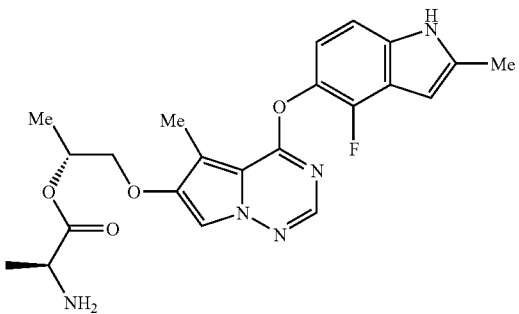

This compound is referred to herein as the "example VEGFR-2 inhibitor."

Human Cancer Tumor Samples:

The use of these samples was approved by the Local Ethics Committee and informed consent was given by all patients prior to surgery. The study population consisted of 26 patients with 30 colorectal liver metastases and 118 patients (age range, 27-91 years; mean 69±13.67 years) with primary colorectal tumors operated at the Royal London Hospital between December 1997 and March 2003. 92 patients underwent a potentially curative surgery, and 24 patients underwent non-curative or palliative surgery. The following parameters were recorded for all patients with primary CRC: age; cancer site (right-sided or left-sided); type of surgical resection (curative or non-curative); tumor-node-metastasis (TNM) classification and Dukes' stage, degree of histological differentiation (well, moderate, or poor); DNA microsatellite stability status (stable or unstable, as assessed by analysis of BAT26 mononucleotide repeat as previously reported; Ref. 15); therapies received pre- and post surgery; recurrences; and survival time after resections.

Human Cancer Blood Samples:

Blood samples (plasma) for ELISA analysis were obtained from Bristol-Myers Squibb Co. sponsored clinical study CA182-002, which is a phase I dose escalation study to determine the safety, pharmacokinetic, and pharmacodynamics of the example VEGFR-2 inhibitor in patients with advanced or metastatic solid tumors. Blood samples were drawn from patients at screening, pre-dose, and post-dose at 4 hours, Day 1, Day 8, Day 26, and end of treatment. Approximately 60 ml of blood was collected for the protocol specific sampling. Detailed instructions regarding the collection, processing, labeling, handling, storage, and shipment of the specimens were provided in the CA182-002 Laboratory Manual.

Mouse Xenograft Tumor Models:

Tumors were propagated in nude mice as subcutaneous (sc) transplants using L2987 and HCT-116 cancer cell lines. Tumor passage occurred approximately every two to four weeks. Tumors were then allowed to grow to the pre-determined size window (100-200 mm$^3$, tumors outside the range were excluded) and animals were evenly distributed to various treatment and control groups. Animals were treated with the example VEGFR-2 inhibitor (100 mg/kg 1 qd×14 days). Treated animals were checked daily for treatment related toxicity/mortality. Each group of animals was weighed before the initiation of treatment (Wt1) and then again following the last treatment dose (Wt2). The difference in body weight (Wt2−Wt1) provided a measure of treatment-related toxicity. Tumor response was determined by measurement of tumors with a caliper twice a week, until the tumors reached a pre-determined target size. Animals that were distributed to various treatment and control groups during the study were eventually sacrificed to obtain tumor and blood samples for genomic and protein analysis.

Mouse Xenograft Blood Samples:

Approximately 100-200 micro liters of whole blood were obtained from the un-treated and the example VEGFR-2 inhibitor treated xenograft tumor models. The whole blood collected was transferred to 2 ml vials containing 5 μl of a protease inhibitor cocktail and mixed several times by inverting. The vials were spun down at 10,000 rpm for 10 minutes in a tabletop micro centrifuge. After centrifugation, two distinct phases of blood were formed, an upper phase and a lower phase. The upper phase was carefully removed from the vial and placed into a new 2 ml vial, thereafter stored at −80° C. to be used for ELISA analysis. The bottom phase was discarded.

RNA Isolation:

The colon tumor samples obtained from cancer patients were snap frozen in liquid nitrogen within 20 minutes of resection and stored thereafter at −80° C. The mouse xenograft tumor samples were split into two halves. One half was mixed in a vial of 10% formalin to be used for IHC and the other half was mixed in 1.0 ml of RNAlater™ RNA Stabilization Reagent (Ambion, Inc., Austin, Tex.) held at room temperature for 30 minutes then stored at −80° C. Total RNA was extracted from the tumor samples using the RNeasy Kit™ (Qiagen, Valencia Calif.). At least 1 μg total RNA with a 260/280 ratio ≧1.8 by spectrophotometry (DU640 UV, Beckman Coulter, Fullerton, Calif.) was required for transcriptional profiling. Briefly, the tumor samples were homogenized in a lysis-binding solution supplied by Qiagen. An equal volume of ethanol was mixed into each sample, the mixture was passed through the filter cartridges provided, and the rest of the extraction protocol was followed (Ambion). RNA yield and quality were assessed on a standard 1% agarose gel. A ratio 28 s/18 s RNA in the range of 1.5 to 2.5 indicated high quality RNA that is free of degradation. RNA samples were stored at −80° C.

Gene Expression Profiling:

Transcriptional profiling was performed on the RNA obtained from the tumor samples. The Affymetrix GeneChip system (Affymetrix, Santa Clara, Calif.) was used for hybridization and scanning of the human U133A and mouse 430A arrays. Data were preprocessed using the MAS 5.0 software. Generation of cRNA followed a standard T7 amplification protocol. Total RNA was reverse-transcribed with SuperScript II (Gibco, Carlsbad, Calif.) in the presence of T7-(dT)$_{24}$ primer to generate first strand cDNA. A second-strand cDNA synthesis was performed in the presence of DNA Polymerase I, DNA ligase, and RNase H (Gibco). The resulting double-stranded cDNA was blunt-ended using T4 DNA polymerase. This double-stranded cDNA was then transcribed into cRNA in the presence of biotin-ribonucleotides using the BioArray High Yield RNA transcript labeling kit (Enzo Life Sciences, Farmingdale, N.Y.). The amplified, biotin-labeled cRNA was purified using Qiagen RNeasy columns (Qiagen Sciences), quantified and fragmented at 94° C. for 35 minutes in the presence of fragmentation buffer (1×). Fragmented cRNA was hybridized to the Affymetrix U113A and 430A arrays overnight at 42° C. The arrays were then placed in the fluidics stations for staining and washing as recommended by Affymetrix protocols. The chips were scanned and raw intensity values were generated for each probe on the arrays. The trimmed mean intensity for each array was scaled to 1,500 to account for minor differences in global chip intensity so that the overall expression level for each sample was comparable.

Transcriptional Profiling Data Analysis:

For the identification of genes co-expressed with VEGFR-2 in human cancer, a Pearson correlation metric was used to compare the gene expression values for each probe set on the human U133A gene chip with the selected VEGFR-2 probe set (probe ID=203934_at). All probe sets included in the H-U133A gene chip data were ranked in descending order of their Pearson values for correlation with VEGFR-2 (203934_at). Probe sets having correlation with VEGFR-2≧0.55 (Pearson correlation results) were considered to be strongly co-expressed with VEGFR-2. The markers of Table 1 were identified as being strongly co-expressed with VEGFR-2 (probe ID=203934_at) from 59 colon tumor gene expression profiles.

The 94 co-expressed VEGFR-2 genes identified from human cancers profiled on U133A arrays were used to identify their corresponding mouse homolog from mouse xenografts tumors profiled on mouse 430A arrays. A T-test analysis was performed on the gene expression profile data generated from un-treated and the example VEGFR-2 inhibitor treated xenograft tumors that were profiled on 430A arrays. A total of 18 markers (probes) were identified, from the list of 94 co-expressed VEGFR-2 genes studied, that significantly changed in mRNA abundance following treatment with a VEGFR-2 modulator (p-value <0.05; T-test results; Table 2). Seven candidate markers from the list of 18 were chosen based on fold-change and T-test scores (C1QR1, COL4A1, CAV1, AGTRL1, TIE, CDH5, NID2) for further analysis at the protein level by IHC and ELISA based assays.

Immunohistochemistry:

Tissue specimens collected for IHC were fixed by using 10% formalin. After fixation, the chemical fixative was discarded and the specimens were submerged in 70% ethanol before being embedded in paraffin blocks. Five micron tissue sections were cut from each block and placed on positively charged microscope slides. The tissue slides were de-paraffined by immersing in xylene. The slides were re-hydrated in 100% ethanol, 95% ethanol, and 70% ethanol. After re-hydration, the slides were washed several times with deionized water at room temperature. Multiple antigen retrieval conditions (Citra, Citra Plus, and AR10) were tested by use of the BioGenex EZ-retriever microwave to determine the best conditions. Staining optimization was performed in an automated BioGenex i6000 IHC system for each of the candidate marker antibodies independently. Both treated and un-treated xenografts were stained in the same run to minimize slide to slide variations. As a control, a rabbit or mouse IgG was used instead of the primary antibody for the candidate marker being studied. All the negative controls gave no staining in the Xenografts.

Enzyme-Linked Immunosorbent Assay (ELISA):

An ELISA method for the detection and measurement of Collagen Type IV and VE-Cadherin on human plasma or any biological sample where the proteins must be detected and measured is described. For collagen type IV ELISA, the kit was provided by Kamiya biomedical company (cat no. KT-035) and the principle method of the assay, a solid phase one-step sandwich ELISA, was as follows. Collagen Type IV in the sample was bound simultaneously by a solid phase monoclonal antibody and a monoclonal antibody-enzyme conjugate, each directed at a different antigenic site. This resulted in the collagen type IV molecule being sandwiched between the solid phase and enzyme-labeled antibodies. After removing unbound enzyme-labeled antibody and samples, the plate was incubated with the enzyme substrate 3,3',5,5'-tetramethylhylbenzidine (TMB). The resultant color development was directly proportional to the amount of collagen IV in the sample. The reaction was terminated by addition of acid and absorbance was measured at 450 nm. A standard curve was prepared from collagen type IV standard dilutions and collagen type IV samples concentration determined. For VE-Cadherin ELISA, the kit provided by Bender Medsystems (cat no. BMS253) was used and the principle method of the assay was as follows. An anti-VE-cadherin coating antibody was adsorbed onto the microwells. VE-cadherin present in the sample bound to antibodies adsorbed to the microwells; a biotin conjugated anti-VE-cadherin antibody was added and bound to VE-cadherin captured by the first antibody. Following incubation, unbound biotin conjugated anti-VE-cadherin was removed during a wash step. Streptavidin-HRP was added and bound to the biotin conjugated anti-VE-cadherin. Following incubation, unbound streptavidin-HRP was removed during a wash step and substrate solution reactive with HRP was added to the wells. A colored product was formed in proportion to the amount of VE-cadherin present in the sample. The reaction was terminated by addition of acid and absorbance was measured at 450 nm. A standard curve was prepared from VE-cadherin standard dilutions and VE-cadherin samples concentration determined.

Example 1

Identification and Use of Biomarkers

Figure 2:
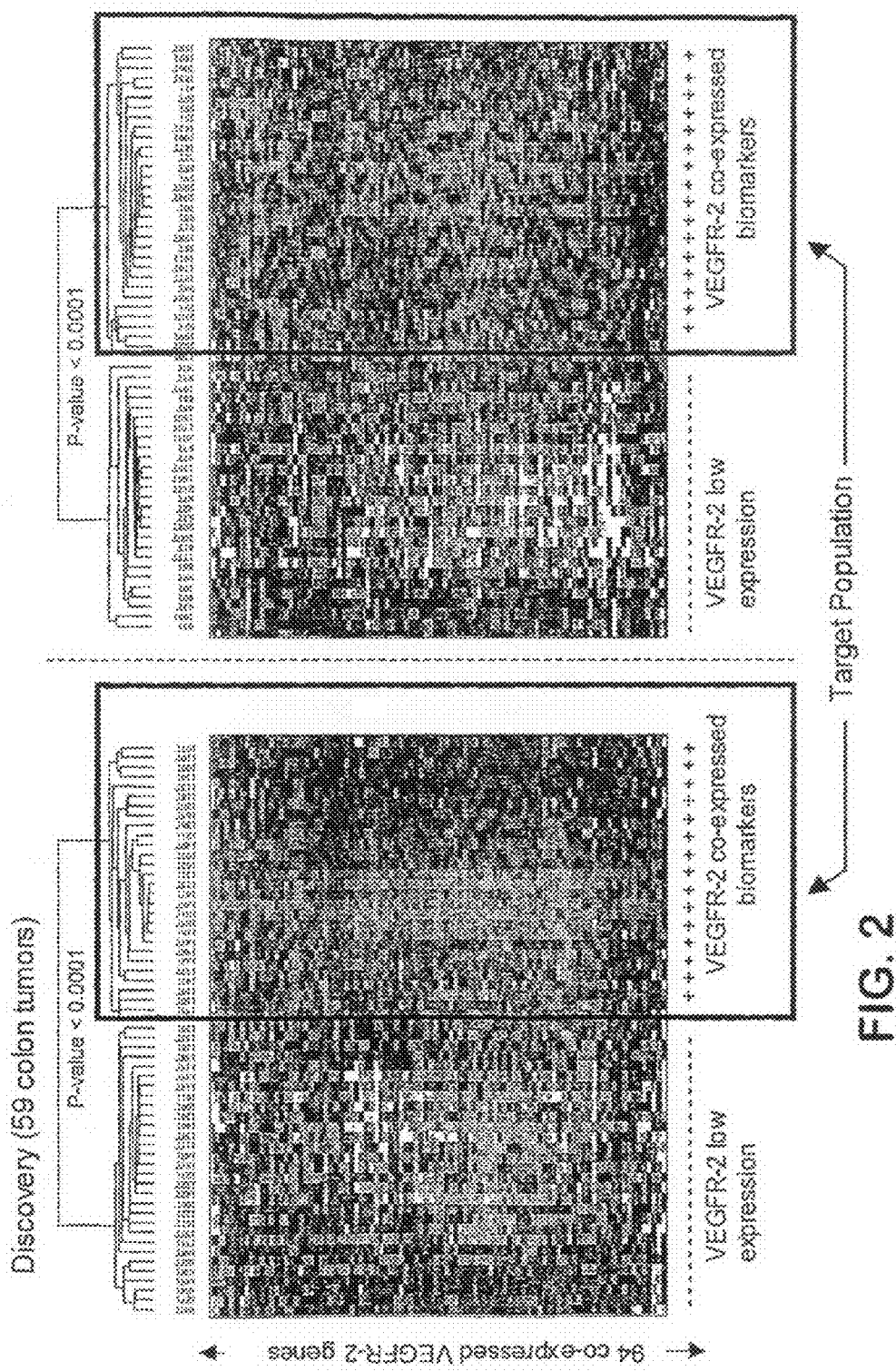
FIG. 2 illustrates hierarchal clustering of the 94 co-expressed VEGFR-2 genes in human colon cancer and the identification of two distinct subgroups of patients.

These experiments were performed on human cancers and mouse xenograft tumor specimens obtained through routine experimental procedures. The expression of known human and mouse genes was examined with Affymetrix U133A and 430A gene chips (Affymetrix, Santa Clara, Calif.) following standard RNA extraction and hybridization procedures. A total of 118 human colon cancer gene expression profiles were used to discover and validate the expression of genes co-expressed with vascular endothelial growth factor receptor 2 (VEGFR-2). The samples were randomized and then split into two separate groups each consisting of 59 samples. Ninety-four genes were identified by a Pearson correlation metric to be co-expressed with VEGFR-2 in 59 human colon cancer gene expression profiles (Table 1) and the next 59 human colon cancer gene expression profiles were used as an independent validation set to see if the initial expression pattern was reproducible (FIG. 1). The results demonstrate that transcriptional profiling has the potential to identify a VEGFR-2 gene expression signature in colon cancer that defines two subgroups of patients (FIG. 2). One subgroup of patients over expressed the 94 VEGFR-2 co-expressed genes (i.e., showed higher expression mRNA levels as indicated with the "+" sign) and the other subgroup showed lower mRNA expression levels (as indicated by a "−" sign). Most of the 94 genes identified to be co-expressed with VEGFR-2 have been previously reported to be expressed by endothelial cells, blood vessels, and stroma.

The 94 genes identified to be co-expressed with VEGFR-2 in human cancer were further studied by use of pre-clinical models to determine if any of the genes were modulated by treatment with the example VEGFR-2 inhibitor.

Figure 3:
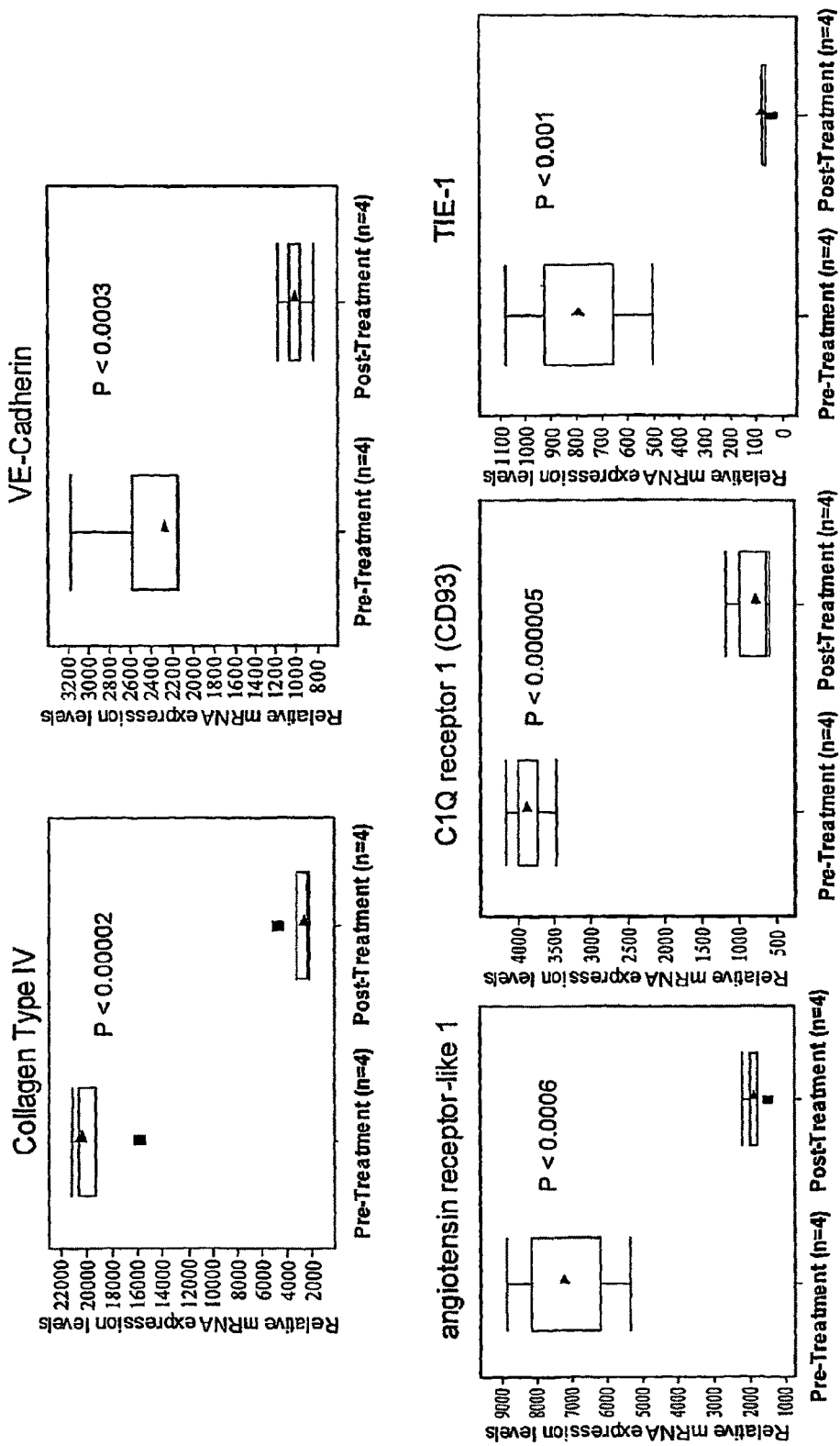
FIG. 3 illustrates gene expression profiling data (mRNA levels).

Eighteen candidate markers from the list of 94 co-expressed VEGFR-2 genes studied were identified by unequal variance two-sample t-statistics on the ranks of the gene expression data to have significant differences in mRNA expression levels between un-treated and the example VEGFR-2 inhibitor treated tumors (Table 2). Box plots were generated from the gene expression profiling data for five of the top biomarkers listed in Table 2. The box plot data graphically shows the difference in mRNA expression levels before and after treatment with the example VEGFR-2 inhibitor (FIG. 3). Greater than 50% of the markers identified to be modulated by the example VEGFR-2 inhibitor had mRNA expression levels reduced or lowered. This information indicates that patients who over express the VEGFR-2 co-expressed markers are more likely to have levels reduced by treatment with the example VEGFR-2 inhibitor. This information is useful in selecting the patient population that will be most likely benefit from the example VEGFR-2 inhibitor therapy.

Seven candidate markers from the list of 18 were selected based on fold-change and T-test scores to be further validated at the protein level in the pre-clinical and clinical samples that were treated with the example VEGFR-2 inhibitor.

Figure 4:
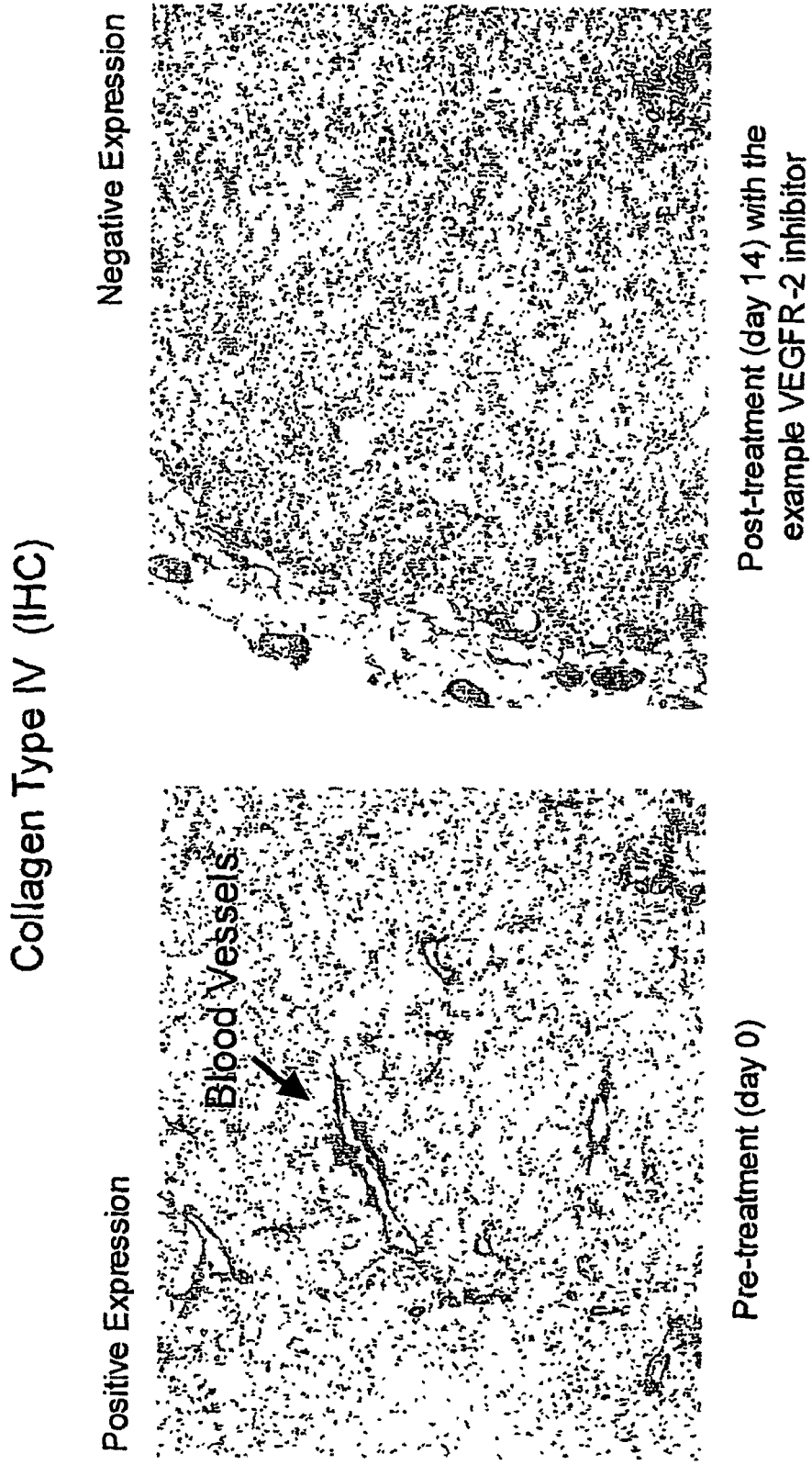
FIG. 4 illustrates validation of the gene expression data by IHC.

Pre-clinical IHC results for candidate genes Collagen type IV (COL4A1), complement component 1, q subcomponent, receptor 1 (C1qR1), and angiotensin receptor-like 1 (AGTRL1) showed positive staining around blood vessels located with in the tumor burden prior to any treatment with the example VEGFR-2 inhibitor. Following treatment with the example VEGFR-2 inhibitor, the tumor samples showed negative or lesser degree of staining relative to the un-treated tumors that had more tumor blood vessels (FIG. 4). These results indicate that Collagen type IV, C1qR1, and angiotensin receptor-like 1 are expressed predominately around tumor blood vessels and the markers are modulated at the protein level by treatment with the example VEGFR-2 inhibitor. The extent to which these markers are affected by treatment with the example VEGFR-2 inhibitor could be reflective of the amount of tumor blood vessel loss or disruption.

Figure 5:
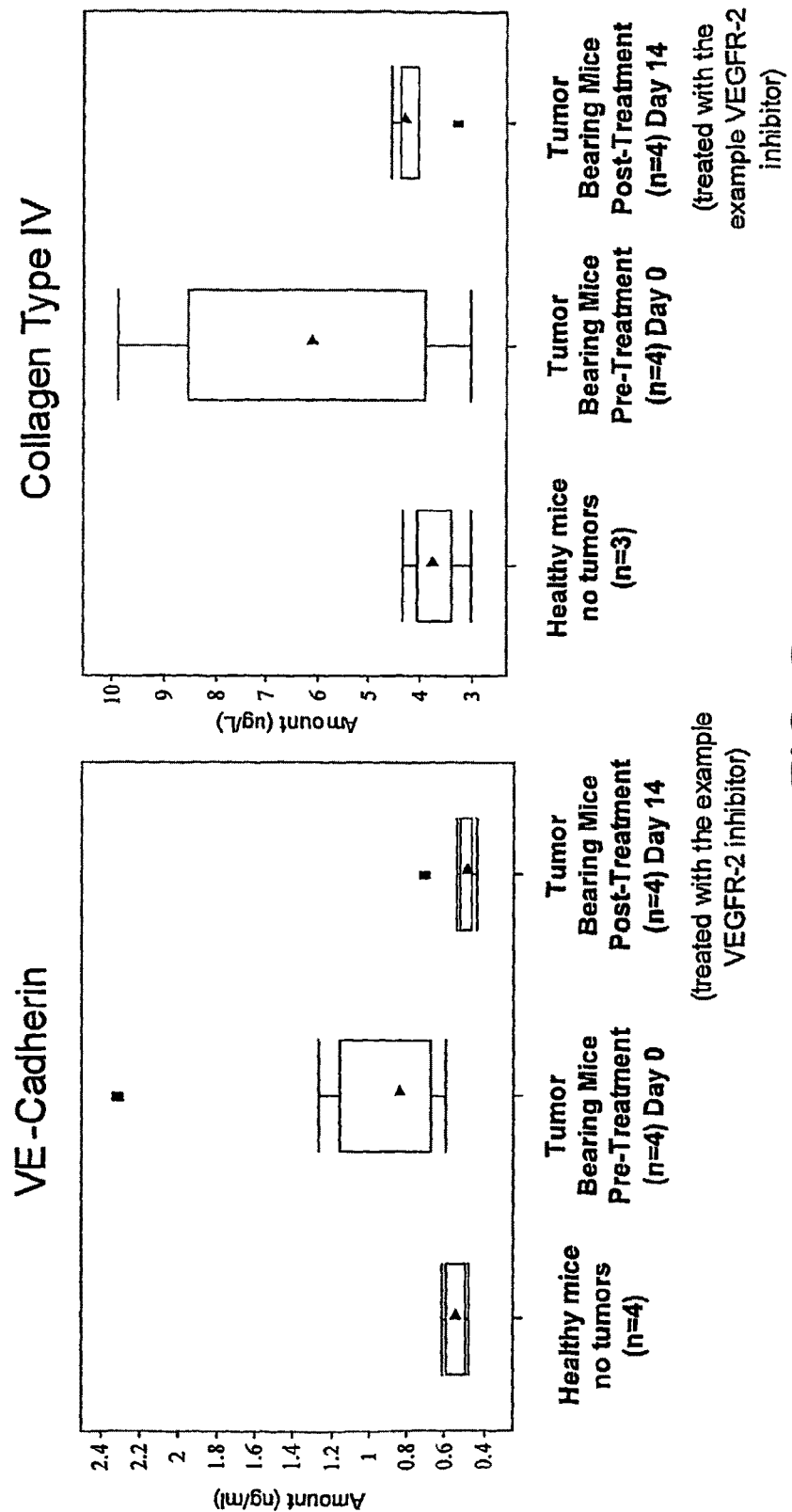
FIG. 5 illustrates validation of the gene expression data by ELISA.

Two commercially available ELISA kits were obtained for two (Collagen type IV and VE-Cadherin) of the eighteen markers identified by gene expression profiling to be modulated by the example VEGFR-2 inhibitor. The ELISA assays were performed with blood samples collected from un-treated and the example VEGFR-2 inhibitor treated tumor bearing mice. Blood samples from healthy mice bearing no tumors were also collected as a control. The results showed that Collagen type IV and VE-Cadherin levels were elevated in the blood samples obtained from the tumor-bearing mice relative to the healthy mice bearing no tumors. This data suggest that the increase levels of Collagen type IV and VE-Cadherin detected in the blood obtained from tumor bearing mice are likely due to the increased number of tumor blood vessels in the organism with tumors since both healthy and tumor bearing mice are otherwise genetically similar. The tumor bearing mice with elevated Collagen type IV and VE-Cadherin blood levels were treated with the example VEGFR-2 inhibitor (100 mg/kg 1 qd×14 days). Following treatment with the example VEGFR-2 inhibitor, the amount of Collagen type IV and VE-Cadherin proteins detected in the blood decreased to levels observed in the healthy mice bearing no tumors (FIG. 5).

Thus, the ELISA results show that blood levels for Collagen type IV and VE-Cadherin are elevated in tumor bearing mice relative to normal mice with no tumors and, following treatment with the example VEGFR-2 inhibitor, the blood levels detected in the tumor bearing mice are reduced or lowered to levels seen in normal mice. This reduction in Collagen Type IV and VE-Cadherin blood levels may be reflective of the extent to which tumor blood vessels growth is inhibited or disrupted.

Figure 6:
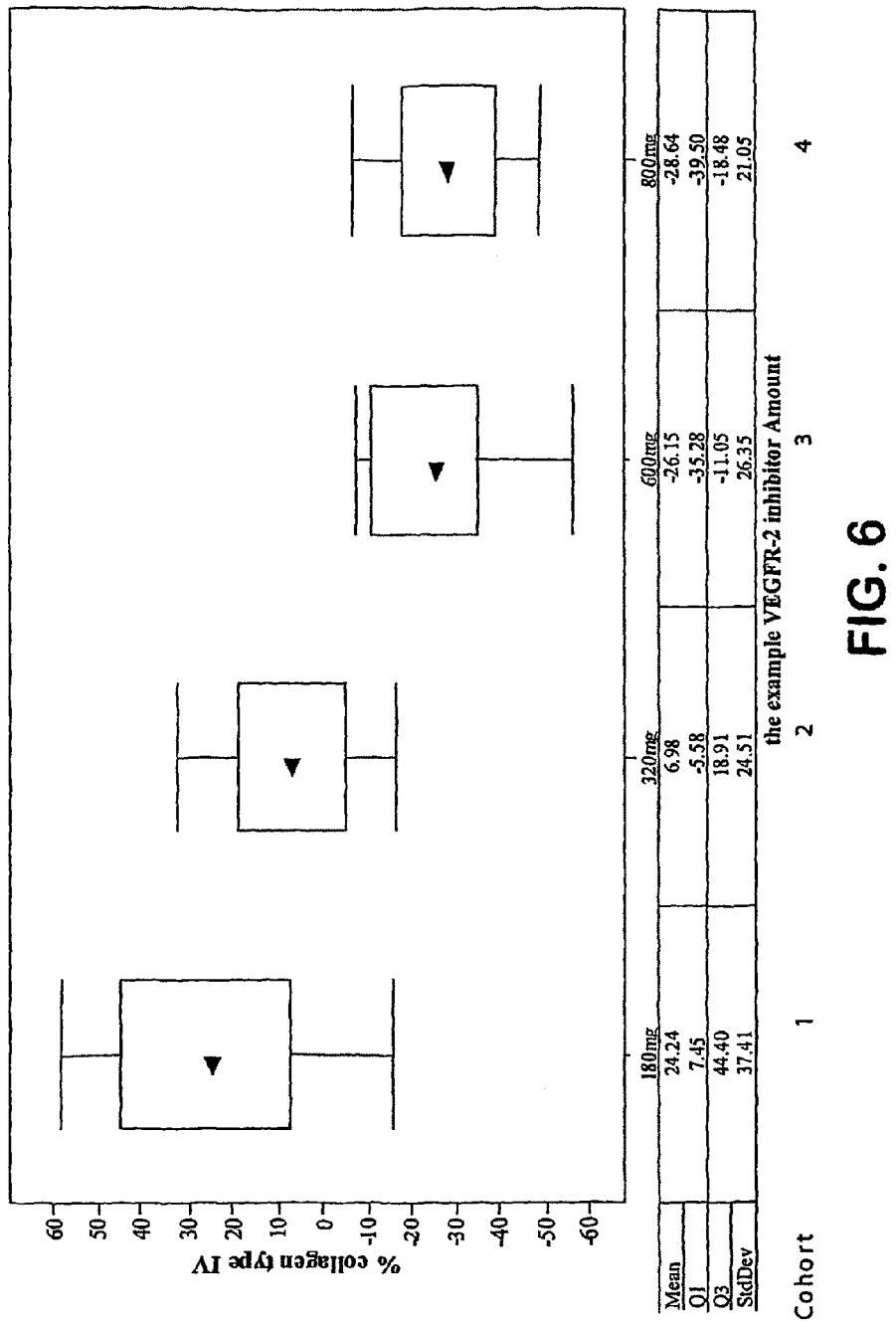
FIG. 6 illustrates collagen type IV ELISA results (3 patients per cohort measured the difference between Day 0 & 26).

Based on the pre-clinical studies, the Collagen type IV ELISA kit was examined as a potential molecular assay to monitor response and validate its expression on specimens obtained from cancer patients who received the example VEGFR-2 inhibitor. Biological samples from twelve cancer patients treated with the example VEGFR-2 inhibitor in protocol CA182002, which is a single agent dose escalation study, three patients each at 180 mg/day, 320 mg/day, 600 mg/day and 800 mg/day, were examined. Collagen Type IV blood levels were determined by an ELISA based assay for each patient at Day 0 (before therapy) and at Day 26 (after treatment). Collagen type IV levels increased on average by 24% at Day 26 in the 180 mg/day cohort; it increased on average only by 7% at Day 26 in the 320 mg/day cohort. In the 600 mg/day cohort, it was reduced on average by 26% at Day 26. In the 800 mg/day cohort, it was reduced only marginally, when compared to the 600 mg/day cohort, by 29% at Day 26. These data showed that increasing the amount of the example VEGFR-2 inhibitor reduced the levels of collagen type IV detected in the blood in a dose-dependent manner (FIG. 6). This information supports the pre-clinical data and provides the necessary information to show that the example VEGFR-2 inhibitor is able to reduce the amount of collagen type IV detected in the blood obtained from actual clinical subjects who were treated with a VEGFR-2 modulator. This result indicates that collagen type IV blood levels serves as a useful pharmacodynamic (PD) biomarker for the example VEGFR-2 inhibitor, as well as other VEGFR-2 modulators.

Figure 7:
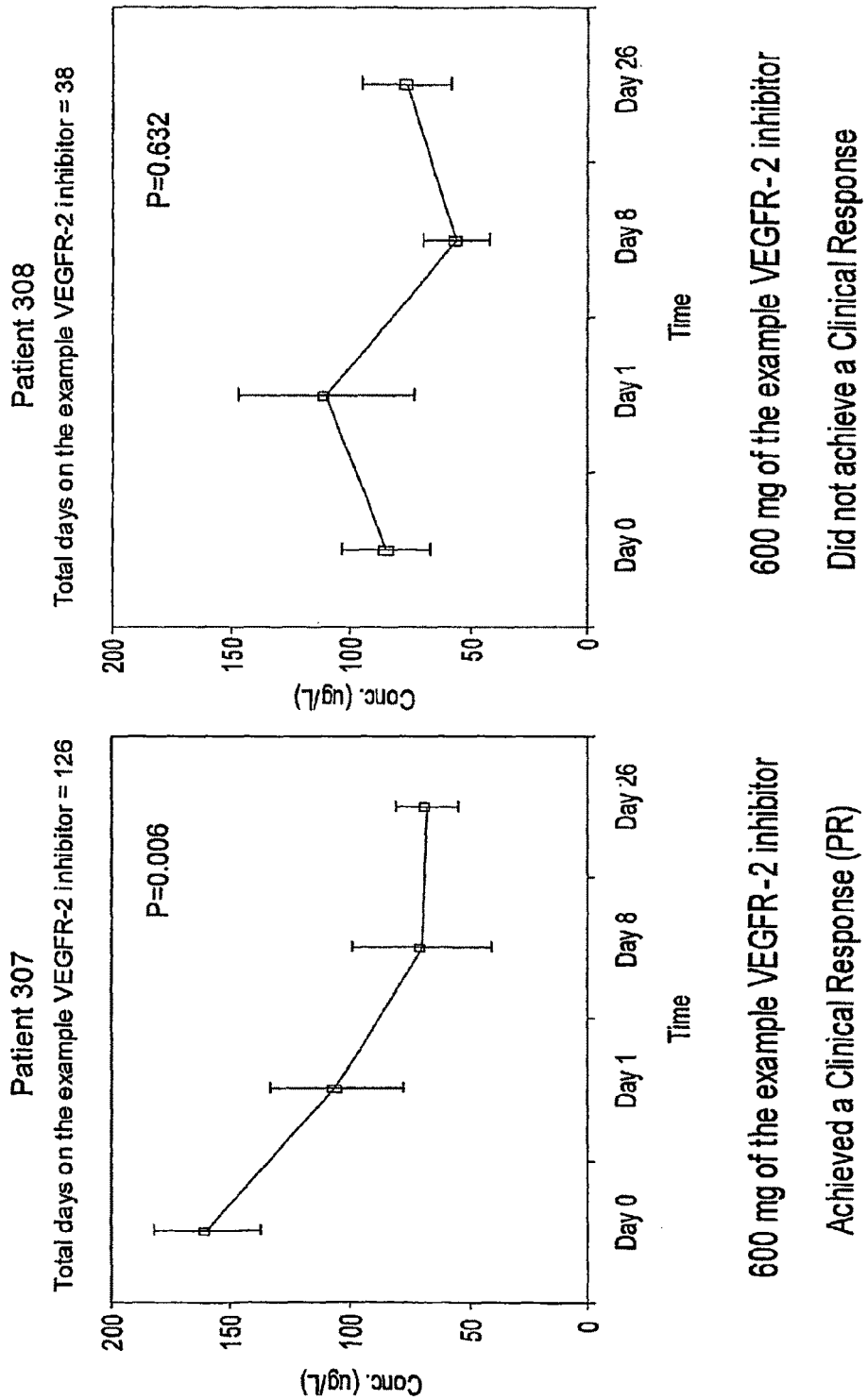
FIG. 7 illustrates individual patient collagen type IV blood level ELISA results.

Collagen type IV ELISA assays were also examined to see if collagen type IV was useful as a biomarker for clinical response to the example VEGFR-2 inhibitor. The results for one patient who was diagnosed with ampulla of vater carcinoma and treated at 600 mg/day (this patient also had the highest levels of collagen type IV detected amongst the twelve patients tested) showed that pre-treatment collagen type IV blood levels were significantly reduced (P=0.006; >50%) between Day 0 and Day 26 (FIG. 7). The reduction in collagen type IV blood levels correlated with clinical evidence of anti-tumor activity. This patient had a partial response to the example VEGFR-2 inhibitor which was defined as a 50% or more decrease in the sum of all target lesion areas compared to the baseline sum, no unequivocal progression of existing non-target lesions and no appearance of new lesions. Additional follow up data showed that this patient remained on the example VEGFR-2 inhibitor therapy for an extended period of time (a total of 126 days). The results for another patient who was treated at the same dose level (600 mg/day) had no significant reduction in collagen type IV levels (P=0.632) between Day 0 and Day 26. This patient did not achieve a clinical response to the example VEGFR-2 inhibitor. Additional follow up data showed that the patient was on the example VEGFR-2 inhibitor for a shorter period of time (a total of 32 days) which further indicated that this patient most likely did not benefit from the example VEGFR-2 inhibitor therapy. Overall, the clinical results from these two evaluable patients confirm the pre-clinical data and indicate that collagen type IV ELISA assay is a clinically useful method to monitor response to a VEGFR-2 modulator(s) such as the example VEGFR-2 inhibitor.

Collagen type IV blood levels as determined by an ELISA based assay or by gene expression profiling and IHC in the tumor serve as a surrogate biomarker that is reflective of the extent to which tumor blood vessel or cancer growth has been inhibited by use of a VEGFR-2 modulator. The degree to which Collagen type IV is reduced by a VEGFR-2 modulator (e.g., the example VEGFR-2 inhibitor) may lead to a meaningful clinical benefit and improved outcome for patients diagnosed with cancer or other VEGFR-2 related diseases.

Figure 8:
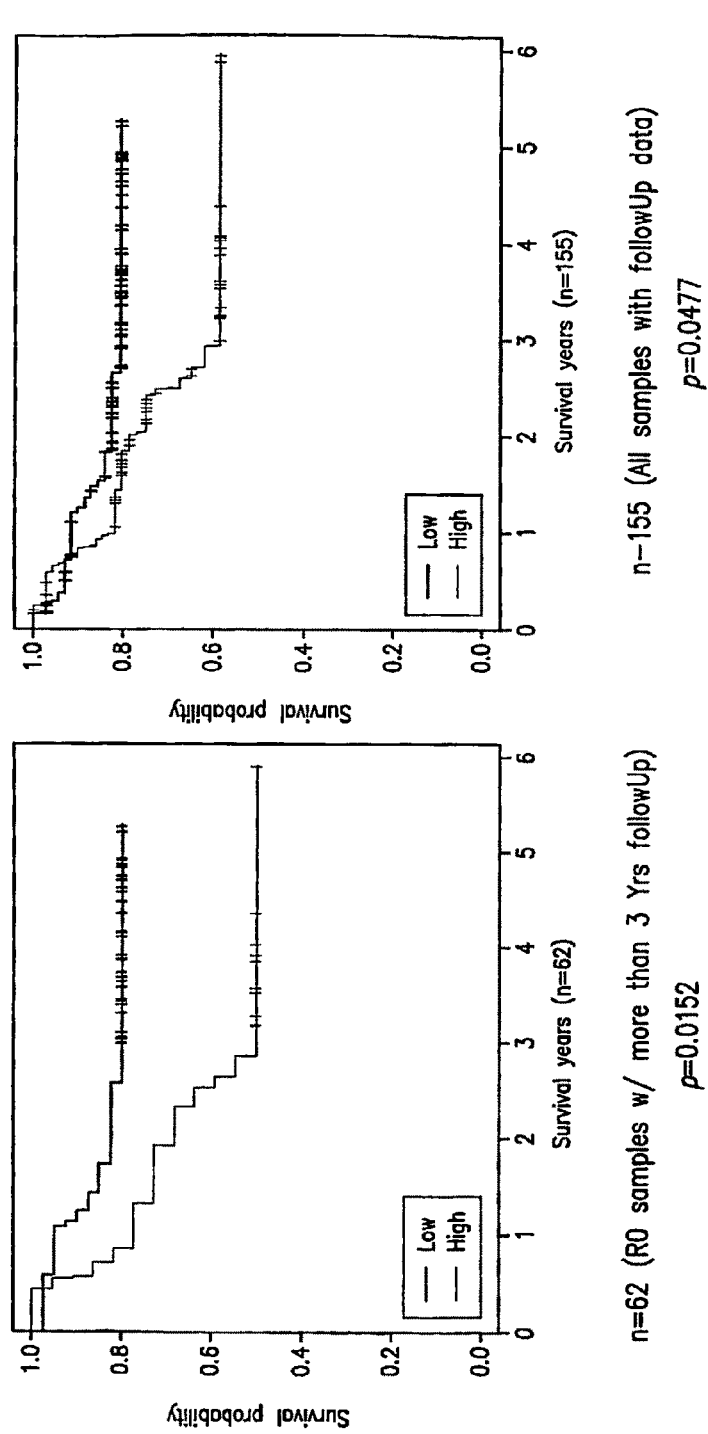
FIG. 8 illustrates disease free survival comparison results based on collagen type IV (COL4A1) mRNA Expression Levels in primary colorectal tumors.

Also provided are additional data on collagen type IV (COL4A1) as a potential prognostic marker in cancer. The results show that colon cancer patients who have higher expression levels of COL4A1 also have a poorer disease-free survival as compared to patients with lower expression levels of COL4A1 (FIG. 8).

Thus, these data coupled with the pre-clinical and clinical studies suggest that patients who express collagen type IV at higher levels may be able to improve their outcome by being treated with the example VEGFR-2 inhibitor which can reduce the collagen type IV levels an inhibit tumor growth. Collagen type IV can be used as a prognostic marker and as a predictive marker to select patients who are more likely to benefit from VEGFR-2 modulator therapy.

Collagen type IV is the major component that makes up the basement membrane of cells. The basement membrane is composed of two subunits of Collagen type IV. One subunit is collagen type IV alpha1 (COL4A1) and the other subunit is collagen type IV alpha 2 (COL4A2). When referencing the effects that the example VEGFR-2 modulator has on collagen type IV, it most likely is affecting both subunits since the two proteins work together to make up the basement membrane Example 2

Xenografts and the Example VEGFR-2 Inhibitor Efficacy

Figure 9:
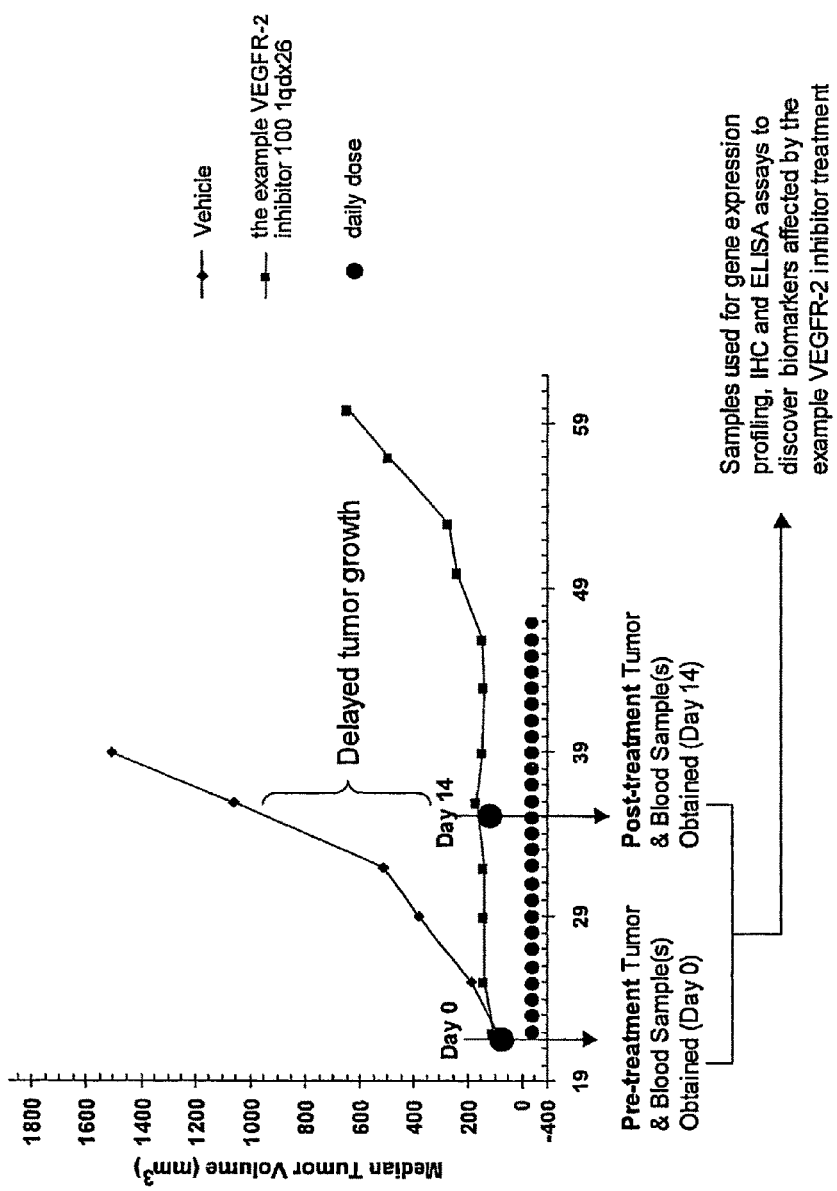
FIG. 9 illustrates the example VEGFR-2 inhibitor efficacy in a L2987 tumor xenograft model.

In this example, the Table 2 biomarkers were identified using mouse xenograft tumor models that were treated with the example VEGFR-2 inhibitor. This provided efficacy data for the example VEGFR-2 inhibitor in the mouse xenograft tumor model used (L2987) which is highly responsive to the example VEGFR-2 inhibitor (FIG. 9).

In Vivo Antitumor Testing:

Tumors were propagated in nude mice as subcutaneous (sc) transplants using tumor fragments obtained from donor mice. Tumor passage occurred approximately every two to four weeks. Tumors were then allowed to grow to the pre-determined size window (usually between 100-200 mg, tumors outside the range were excluded) and animals were evenly distributed to various treatment and control groups. Animals were treated with the example VEGFR-2 inhibitor (100 mg/kg 1 qd×26). Treated animals were checked daily for treatment related toxicity/mortality. Each group of animals was weighed before the initiation of treatment (Wt1) and then again following the last treatment dose (Wt2). The difference in body weight (Wt2−Wt1) provided a measure of treatment-related toxicity. Tumor response was determined by measurement of tumors with a caliper twice a week, until the tumors reached a predetermined target size of 1 gm or became necrotic. Tumor weights (mg) were estimated from the formula:

$$\text{Tumor weight} = (\text{length} \times \text{width}2)/2$$

Antitumor activity was determined in terms of primary tumor growth inhibition. This was determined in two ways: (i) calculating the relative median tumor weight (MTW) of treated (T) and control (C) mice at various time points (effects were expressed as % T/C); and (ii) calculating the tumor growth delay (T−C value), defined as the difference in time (days) required for the treated tumors (T) to reach a predetermined target size compared to those of the control group (C). Statistical evaluations of data were performed using Gehan's generalized Wilcoxon test for comparisons of time to reach tumor target size. Statistical significance was declared at $p<0.05$. Antitumor activity was defined as a continuous MTW % $T/C \leq 50\%$ for at least 1 tumor volume doubling time (TVDT) any time after the start of treatment, where TVDT (tumor volume doubling time)=median time (days) for control tumors to reach target size−median time (days) for control tumors to reach half the target size. In addition, treatment groups had to be accompanied by a statistically significant tumor growth delay (T−C value) ($p<0.05$) to be termed active.

Treated animals were checked daily for treatment related toxicity/mortality. When death occurred, the day of death was recorded. Treated mice dying prior to having their tumors reach target size were considered to have died from drug toxicity. No control mice died bearing tumors less than target size. Treatment groups with more than one death caused by drug toxicity were considered to have had excessively toxic treatments and their data were not included in the evaluation of the compound's antitumor efficacy.

Example 3

Production of Antibodies Against the Biomarkers

Antibodies against the biomarkers can be prepared by a variety of methods. For example, cells expressing an biomarker polypeptide can be administered to an animal to induce the production of sera containing polyclonal antibodies directed to the expressed polypeptides. In one aspect, the biomarker protein is prepared and isolated or otherwise purified to render it substantially free of natural contaminants, using techniques commonly practiced in the art. Such a preparation is then introduced into an animal in order to produce polyclonal antisera of greater specific activity for the expressed and isolated polypeptide.

In one aspect, the antibodies of the invention are monoclonal antibodies (or protein binding fragments thereof). Cells expressing the biomarker polypeptide can be cultured in any suitable tissue culture medium, however, it is preferable to culture cells in Earle's modified Eagle's medium supplemented to contain 10% fetal bovine serum (inactivated at about 56° C.), and supplemented to contain about 10 g/l nonessential amino acids, about 1.00 U/ml penicillin, and about 100 µg/ml streptomycin.

The splenocytes of immunized (and boosted) mice can be extracted and fused with a suitable myeloma cell line. Any suitable myeloma cell line can be employed in accordance with the invention, however, it is preferable to employ the parent myeloma cell line (SP2/0), available from the ATCC. After fusion, the resulting hybridoma cells are selectively maintained in HAT medium, and then cloned by limiting dilution as described by Wands et al. (1981, Gastroenterology, 80:225-232). The hybridoma cells obtained through such a selection are then assayed to identify those cell clones that secrete antibodies capable of binding to the polypeptide immunogen, or a portion thereof.

Alternatively, additional antibodies capable of binding to the biomarker polypeptide can be produced in a two-step procedure using anti-idiotypic antibodies. Such a method makes use of the fact that antibodies are themselves antigens and, therefore, it is possible to obtain an antibody that binds to a second antibody. In accordance with this method, protein specific antibodies can be used to immunize an animal, preferably a mouse. The splenocytes of such an immunized animal are then used to produce hybridoma cells, and the hybridoma cells are screened to identify clones that produce an antibody whose ability to bind to the protein-specific antibody can be blocked by the polypeptide. Such antibodies comprise anti-idiotypic antibodies to the protein-specific antibody and can be used to immunize an animal to induce the formation of further protein-specific antibodies.

Example 4

Immunofluorescence Assays

The following immunofluorescence protocol may be used, for example, to verify VEGFR-2 biomarker protein expression on cells or, for example, to check for the presence of one or more antibodies that bind VEGFR-2 biomarkers expressed on the surface of cells. Briefly, Lab-Tek II chamber slides are coated overnight at 4° C. with 10 micrograms/milliliter (µg/ml) of bovine collagen Type II in DPBS containing calcium and magnesium (DPBS++). The slides are then washed twice with cold DPBS++ and seeded with 8000 CHO-CCR5 or CHO pC4 transfected cells in a total volume of 125 µl and incubated at 37° C. in the presence of 95% oxygen/5% carbon dioxide.

The culture medium is gently removed by aspiration and the adherent cells are washed twice with DPBS++ at ambient temperature. The slides are blocked with DPBS++ containing 0.2% BSA (blocker) at 0-4° C. for one hour. The blocking solution is gently removed by aspiration, and 125 µl of antibody containing solution (an antibody containing solution may be, for example, a hybridoma culture supernatant which is usually used undiluted, or serum/plasma which is usually diluted, e.g., a dilution of about 1/100 dilution). The slides are incubated for 1 hour at 0-4° C. Antibody solutions are then gently removed by aspiration and the cells are washed five times with 400 µl of ice cold blocking solution. Next, 125 µl of 1 µg/ml rhodamine labeled secondary antibody (e.g., anti-human IgG) in blocker solution is added to the cells. Again, cells are incubated for 1 hour at 0-4° C.

The secondary antibody solution is then gently removed by aspiration and the cells are washed three times with 400 µl of ice cold blocking solution, and five times with cold DPBS++. The cells are then fixed with 125 µl of 3.7% formaldehyde in DPBS++ for 15 minutes at ambient temperature. Thereafter, the cells are washed five times with 400 µl of DPBS++ at ambient temperature. Finally, the cells are mounted in 50% aqueous glycerol and viewed in a fluorescence microscope using rhodamine filters.

SEQUENCE LISTING (184 sequences)

SEQ ID NO: 1 - DNA, 5830 bp, Homo sapiens
actgagtcccgggaccccgggagagcggtcagtgtgtggtcgctgcgtttcctctgcctgcgccgggcatcacttgcgcgccgcagaaagtccgtctggcagcctggatatcctctcctaccggcacccgcagacgcccctgcagccgccggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacaccccaactcccggacatcacatgagaggtctgctcagattttgaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctcttttttcattcatttaaaaagcattatcatgcccctgctgcgggtctcaccatgggtttagaacaaagagcttcaagcaatggccccatcctcaaagaagtagcagtacctggggagctgacacttctgtaaaactagaagataaaccaggcaacgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttagctgtctccttgccaagccccaggaagaaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttga

SEQ ID NO: 2 - DNA, 1647 bp, Homo sapiens
gcgggcgtcactccggccatcgtccccacctccacctgggccgcccggcaggcaggcgacggaggcccgggagccatgggtgactggggcttcctggagaagttgctggaccaggtccaggagcactcgaccgtggtgggtaagatctggctgacggtgctcttcatcttccgcatcctcatcctgggcctggccggcgagtcagtgtggggtgacgagcagtcagatttcgagtgtaacacggcccagccaggctgcaccaacgtctgctatgaccaggccttccccatctcccacatccgctactgggtgctgcagttcctcttcgtcagcacacccaccctggtctacctgggccatgtcatttacctgtctcggcgagaagagcggctgcggcagaaggagggggagctgcgggcactgccggccaaggacccacaggtggagcgggcgctggcggccgtagagcgtcagatggccaagatctcggtggcagaagatggtcgcctgcgcatccgcggagcactgatgggcacctatgtcgccagtgtgctctgcaagagtgtgctagaggcaggcttcctctatggccagtggcgcctgtacggctggaccatggagcccgtgtttgtgtgccagcgagcaccctgcccctacctcgtggactgctttgtctctcgccccacggagaagaccatcttcatcatcttcatgttggtggttggactcatctccctggtgcttaacctgctggagttggtgcacctgctgtgtcgctgcctcagccgggggatgagggcacggcaaggccaagacgcacccccgacccagggcacctcctcagacccttacacggaccaggtcttcttctacctccccgtgggccaggggccctcatccccaccatgccccacctacaatgggctctcatccagtgagcagaactgggccaacctgaccacagaggagaggctggcgtcttccaggccccctctcttcctggacccaccccctcagaatggccaaaaacccccaagtcgtcccagcagctctgcttctaagaagcagtatgtatagaggcctgtggcttatgtcacccaacagaggggtcctgagaagtctggctgcctgggatgccccctgccccctcctggaaggctctgcagagatgactgggctggggaagcagatgcttgctggccatggagcctcattgcaagttgttcttgaacacctgaggccttcctggtgcccaccaggcactacggcttcctctccagaatgtggctttgcctgagcacagacagtcagcatggaatgctcttggccaagggtactgggggccctctggccttttgcagctgatccagaggaacccagagccaacttaccccaacctcaccctatggaacagtcacctgtgcgcaggttgtcctcaaaccctctcctcacaggaaaaggcggattgaggctgctgggtcagccttgatggcacagacagagcttgtgccggatttggccctgtcaaggggactggtgccttgttttcatcactccttcctagttctactgttcaagcttctgaaataaacaggacttgatcacaaaaaaaaaaaaaaaaaaaaaaaaaaaaaaaaaaaaaaaaaa

SEQ ID NO: 3 - DNA, 6699 bp, Homo sapiens
aaagccctcagcctttgtgtccttctctgcgccggagtggctgcagctcacccctcagctccccttggggcccagctgggagccgagatagaagctcctgtcgccgctgggcttctcgcctcccgcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccagccgctccttcccaaccgcctgcccaagtggtctgagggcccctgtgggagcccaggctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctctgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggctgccgaccaggattccggctgctggatgacctggtgacctgtgcctctcgaaacccttgcagctccagcccatgtcgtgggggggccacgtgcgtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgcgctgcaacagccagtcccacaaggggccccgagggcacccccaaggctacacccaccacaagtagaccttcgctgtcatctgacgcccccatcacatctgccccactcaagatgctggcccccagtgggtcctcaggcgtctggagggagcccagcatccatcacgccacagctgcctctggcccccaggagcctgcaggtggggactcctccgtggccacacaaaacaacgatggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacagtccgacacctgggacagactgctgaaagtgaggtggccctagagacactagagtcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggctggggctaaggggctcccctgaatatcttctctgctcacttccaccatctaagaggaaaaggtgagttgctcatgctgattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcctcagacaccctgcctgtggccccgcctccacttcatcctgcccggaatgccagtgctccgagctcagacagaggaagccctgcagaaagttccatcaggctgtttcctaaaggatgtgtgaacgggagatgatgcactgtgttttgaaagttgtcattttaaagcattttagcacagttcatagtccacagttgatgcagcatcctgagattttaaatcctgaagtgtgggtggcgcacacaccaagtagggagctagtcaggcagtttgcttaaggaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgcagtcgatagtgtgcactctttctctctctctctctctctcacacacacacacacacacacacacacacacacagagacacggcaccattctgcctggggcactggaacacattcctgggggtcaccgatggtcagagtcactagaagttacctgagtatctctgggaggcctcatgtctcctgtgggctttttaccaccactgtgcaggagaacagacagaggaaatgtgtctccctccaaggccccaaagcctcagagaaagggtgtttctggttttgccttagcaatgcatcggtctctgaggtgacactctggagtggttgaagggccacaaggtgcagggttaatactcttgccagttttgaaatatagatgctatggttcagattgtttttaatagaaaactaaaggggcaggggaagtgaaaggaaagatggaggttttgtgcggctcgatggggcatttggaacttctttttaaagtcatctcatggtctccagttttcagttggaactctggtgtttaacacttaagggagacaaaggctgtgtccatttggcaaaacttccttggccacgagactctaggtgatgtgtgaagctgggcagtctgtggtgtggagagcagccatctgtctggccattcagaggattctaaagacatggctggatgcgctgctgaccaacatcagcacttaaataaatgcaaatgcaacatttctccctctgggccttgaaaatccttgcccttatcatttggggtgaaggagacatttctgtccttggcttcccacagccccaacgcagtctgtgtatgattcctgggatccaacgagccctcctattttcacagtgttctgattgctctcacagcccaggcccatcgtctgttctctgaatgcagccctgttctcaacaacagggaggtcatggaacccctctgtggaacccacaaggggagaaatgggtgataaagaatccagttcctcaaaaccttccctggcaggctgggtccctctcctgctgggtggtgctttctcttgcacaccactcccaccacggggggagagccagcaacccaaccagacagctcaggttgtgcatctgatggaaaccactgggctcaaacacgtgctttattctcctgtttatttttgctgttactttgaagcatggaaattcttgtttgggggatcttggggctacagtagtgggtaaacaaatgcccaccggccaagaggccattaacaaatcgtccttgtcctgaggggccccagcttgctcgggcgtggcacagtggggaatccaagggtcacagtatggggagaggtgcaccctgccacctgctaacttctcgctagacacagtgtttctgcccaggtgacctgttcagcagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagaaaaaccagggcaggacagttatcgacaatgcattagaacttggtgagcatcctctgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccatcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaatgctaaatgagaatgtaagtatttttaaatgtgtgtatttcaaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagctttctgttatgtgcctatcctaataaactcttaaacacatt

SEQ ID NO: 4 - DNA, 4098 bp, Homo sapiens
gacggtcggctgacaggctccacagagctccactcacgctcaggccctggacggacaggcagtccaacggaacagaaacatccctcagccccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaacaaaaaaa

SEQ ID NO: 5 - DNA, 5514 bp, Homo sapiens
aatcccagcactttgggaggccgagatgggcggatcacttgaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattaccgacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatatgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtttggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcaggagatagccctcctttgtccttctcccaaactaatgtgcagatgagcagcacggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgctcaggatatccaggaaaataactttgcagagagcttagtgatgacaaccactgtcagccacaatacgactatgccattcaggatttcaatgacttttaagaacaatagcccttcaggcggcgaaacgaagtgtgtcttctggaacttcaggcttgccaacaacacaggggggtgggacagcagtgggtgctatgttgaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaatcggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaaggaaggaaggaaagaagggagggaaacagggagaaagggaaaaagaagaaaaagagaaagatgaaaataggaacaaataaagacaaacaacattaagagccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattataaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaaaaaaaaaaaaaa

SEQ ID NO: 6 - DNA, 2984 bp, Homo sapiens
gaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagtctggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgcatgaattcacaaacaaatggctgtaaaactaaacatacatgttgggcatgattctacccttattgccccaagagacctagctaaggtctataaacatgaagggaaaattagcttttagttttaaaactctttatcccatcttgattggggcagttgactttttttttgcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcctacttctatatcattaggaaaacatcttagttgatgctacaaaacaccttgtcaacctcttcctgtcttaccaaacagtgggagggaattcctagctgtaaatataaattttgtcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgctaaaaaaaaaaaaaa

SEQ ID NO: 7 - DNA, 3609 bp, Homo sapiens
aggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggaaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccgggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcaggtagtgtggctactccttgtcctatgcacatcctttaactgtcccctgattctgccccgccctgtcctcctctactgctttattctttctcagaggtttgtggtttaggggaaagagactgggctctacagacctgaccctgcacaagccatttaatctcactcagcctcagtttctccattggtatgaaatgggggaaagtcatattgatcctaaaatgttgaagcctgagtctggacgcagtaaaagcttgtttccctctgctgctttcttagatctgcaatcgtctttcctcccttctttccttgtagtttttcccccaccactctctgcagctgccgctccttatccctgccttctggcaccaatcccctcctacagctcgtccccctccctccatccatccttctcccctgtctactttcttgttctgaagggctactaagggttaaggatcccaaagcttgcagagactgaccctgtttaagctttctatcctgttttctgagtgtgaggcagggaatgggctggggccgggggtgggctgtgtgtcagcagataattagtgctccagcccttagatctgggagctccagagcttgccctaaaattggatcacttccctgtcattttgggcattggggctagtgtgattcctgcagttcccccatggcaccatgacactgactagatatgctttctccaaattgtccgcagaccctttcatccttcctctattttctatgagaattggaaggcagcagggctgatgaatggatgtactccttggtttcattatgtgagtggggagttgggaagggcaactagagagagaggatggaggggtgtctgcatttagtccagacactgcttggctcgctccccgagtcctcctgtttctgacttcctgcataactgtgagctgaagggtttcctcatctccccatcttaccccatcatactgatttctttcttgggcactggtgctacttggtgccaagaatcatgttgtttgggatggagatgcctgcctcttgtctgtgtgtgttgtacttatatgtctatatggatgagcctggcatgaacagcagtgtgcctgggtcatttggacaaatctcctcccaccccccaatccactgcaactctgctgttcacacattacccttggcagggggtggtggggggcagggacacactgaggcaatgaaaaatgtagaataaaaatgagtccaccccctactggatttgggggctccaacggctggtccgtgctttaggagcgaagttaatgtttgcaccaggcttcctgtagggagatccctccccaaagcagctggcgccaaggcttgggggcatcctactgagctgggttcctgctccttcttgggctccatgaaggaagtaagaggctagttgagagcctcccttggcccctttccggtgcctccccgcctggcttcaaatttatgagcattgccctcatcgtcctttcttgttccagggtcagtggccctcttcctaaggaggcctcctgcttgccatgggccaaaaggcacggggtgggttttttctctccctaccctcaggattggacctcttggcttctgctggattggggatctgggaatagggactggagcaagtgtgcagatagcatgatgtctacactgccagagagaccgtgaggatgaaattaatagtggggcctttgtgagctagaggctgggagtgtctattccgggttttgttcttggaggactatgaaagtgaaggacaagacatgagcgatggagataagaaaagcccagcttgatgtgaatggacatcttgaccctccctggaatgacgccagctctgggggcagagggaggaggagaggggaaggggctcctcacagcctagtctccccatcttaagatagcatctttcacagagtcacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgc

SEQ ID NO: 8 - DNA, 3828 bp, Homo sapiens
aagacaacgtcactagcagtttctggagctacttgccaaggctgagtgtgagctgagcctgccccaccaccaagatgatcctgagcttgctgttcagccttgggggccccctgggctgggggctgctgggggcatgggcccaggcttccagtactagcctctctgatctgcagagctccaggacacctggggtctggaaggcagaggctgaggacaccagcaaggaccccgttggacgtaactggtgcccctacccaatgtccaagctggtcaccttactagctctttgcaaaacagagaaattcctcatccactcgcagcagccgtgtccgcagggagctccagactgccagaaagtcaaagtcatgtaccgcatggcccacaagccagtgtaccaggtcaagcagaaggtgctgacctctttggcctggaggtgctgccctggctacacgggccccaactgcgagcaccacgattccatggcaatccctgagcctgcagatcctggtgacagccaccaggaacctcaggatggaccagtcagcttcaaacctggccaccttgctgcagtgatcaatgaggttgaggtgcaacaggaacagcaggaacatctgctgggagatctccagaatgatgtgcaccgggtggcagacagcctgccaggcctgtggaaagccctgcctggtaacctcacagctgcagtgatggaagcaaatcaaacagggcacgagttccctgatagatccttggagcaggtgctgctaccccacgtggacaccttcctacaagtgcatttcagccccatctggaggagctttaaccaaagcctgcacagccttacccaggccataagaaacctgtctcttgacgtggaggccaaccgccaggccatctccagagtccaggacagtgccgtggccagggctgacttccaggagcttggtgccaaatttgaggccaaggtccaggagaacactcagagagtgggtcagctgcgacaggacgtggaggaccgcctgcacgcccagcactttaccctgcaccgctcgatctcagagctccaagccgatgtggacaccaaattgaagaggctgcacaaggctcaggaggccccagggaccaatggcagtctggtgttggcaacgcctggggctggggcaaggcctgagccggacagcctgcaggccaggctgggccagctgcagaggaacctctcagagctgcacatgaccacggcccgcagggaggaggagttgcagtacaccctggaggacatgagggccaccctgacccggcacgtggatgagatcaaggaactgtactccgaatcggacgagactttcgatcagattagcaaggtggagcggcaggtggaggagctgcaggtgaaccacacggcgctccgtgagctgcgcgtgatcctgatggagaagtctctgatcatggaggagaacaaggaggaggtggagcggcagctcctggagctcaacctcacgctgcagcacctgcagggtggccatgccgacctcatcaagtacgtgaaggactgcaattgccagaagctctatttagacctggacgtcatccgggagggccagagggacgccacgcgtgccctggaggagacccaggtgagcctggacgagcggcggcagctggacggctcctccctgcaggccctgcagaacgccgtggacgccgtgtcgctggccgtggacgcgcacaaagcggagggcgagcgggcgcgggcggccacgtcgcggctccggagccaagtgcaggcgctggatgacgaggtgggcgcgctgaaggcggccgcggccgaggcccgccacgaggtgcgccagctgcacagcgccttcgccgccctgctggaggacgcgctgcggcacgaggcggtgctggccgcgctcttcggggaggaggtgctggaggagatgtctgagcagacgccgggaccgctgcccctgagctacgagcagatccgcgtggccctgcaggacgccgctagcgggctgcaggagcaggcgctcggctgggacgagctggccgcccgagtgacggccctggagcaggcctcggagcccccgcggccggcagagcacctggagcccagccacgacgcgggccgcgaggaggccgccaccaccgccctggccgggctggcgcgggagctccagagcctgagcaacgacgtcaagaatgtcgggcggtgctgcgaggccgaggccggggccggggccgcctccctcaacgcctcccttgacggcctccacaacgcactcttcgccactcagcgcagcttggagcagcaccagcggctcttccacagcctctttgggaacttccaagggctcatggaagccaacgtcagcctggacctggggaagctgcagaccatgctgagcaggaaagggaagaagcagcagaaagacctggaagctccccggaagagggacaagaaggaagcggagcctttggtggacatacgggtcacagggcctgtgccaggtgccttgggcgcggcgctctgggaggcaggatcccctgtggccttctatgccagcttttcagaagggacggctgccctgcagacagtgaagttcaacaccacatacatcaacattggcagcagctacttccctgaacatggctacttccgagcccctgagcgtggtgtctacctgtttgcagtgagcgttgaatttggcccagggccaggcaccgggcagctggtgtttggaggtcaccatcggactccagtctgtaccactgggcaggggagtggaagcacagcaacggtctttgccatggctgagctgcagaagggtgagcgagtatggtttgagttaacccagggatcaataacaaagagaagcctgtcgggcactgcatttgggggcttcctgatgtttaagacctgaaccccagccccaatctgatcagacatcatggactcgcccagctctcctcggcctggggctctggccaaggatgggctggaggtcattcagttggtctgtctcttccctggaaaccttctgcaaagatggtgtggtgtacgtggcttccctgtaaccacatggggcttggccatttctccatgatgagaaggactggaatgcttctccgggcaggacatggtcctaggaagcctgaaccttggcttggcatgccttctcagacagcacggcctgggctccaactcttcaccacaccctgtattctacaacttctttggtgttttgctcctcctgtggttggaaacttctgtacaacactttaaacttttctcttgcttcctcttctcttctcccttatcgtatgatagaaagacattcttccccaggaggaatgtttaaaatggaggcaacattttggccaacattggaaagcactagagggcaatgggattaaaccaacctgcttggtctctattagtcagtaatgaagacgacagcctggccaaccaagggaaaggaaattagtatctttagtttcagtcattccttgtaggatatggtttagctgtgcccccacctaaaatatcatcttgaattgtaatccctataatccccacatcaagggagagatcaggtggaggtaattggatcttgggggcggttcccccatgctgttcttgtgatagttctcacgagatctgatgattttataagtttgatagttcctcctgtgttcattctccttcctgccaccttgtgaagatgccttggttcctcttcactgtctgccatgattgtaagtttcctgaggcctccccagccatgtggaacagtgagtcaattaaacctctttcctttataaatt

SEQ ID NO: 9 - DNA, 2822 bp, Homo sapiens
cgccaccactgcggccaccgccaatgaaacgcctcccgctcctagtggttttttccactttgttgaattgttcctatactcaaaattgcaccaagacaccttgtctcccaaatgcaaaatgtgaaatacgcaatggaattgaagcctgctattgcaacatgggattttcaggaaatggtgtcacaatttgtgaagatgataatgaatgtggaaatttaactcagtcctgtggcgaaaatgctaattgcactaacacagaaggaagttattattgtatgtgtgtacctggcttcagatccagcagtaaccaagacaggtttatcactaatgatggaaccgtctgtatagaaaatgtgaatgcaaactgccatttagataatgtctgtatagctgcaaatattaataaaactttaacaaaaatcagatccataaaagaacctgtggctttgctacaagaagtctatagaaattctgtgacagatctttcaccaacagatataattacatatatagaaatattagctgaatcatcttcattactaggttacaagaacaacactatctcagccaaggacaccctttctaactcaactcttactgaatttgtaaaaaccgtgaataattttgttcaaagggatacatttgtagtttgggacaagttatctgtgaatcataggagaacacatcttacaaaactcatgcacactgttgaacaagctactttaaggatatcccagagcttccaaaagaccacagagtttgatacaaattcaacggatatagctctcaaagttttcttttttgattcatataacatgaaacatattcatcctcatatgaatatggatggagactacataaatatatttccaaagagaaaagctgcatatgattcaaatggcaatgttgcagttgcatttttatattataagagtattggtcctttgctttcatcatctgacaacttcttattgaaacctcaaaattatgataattctgaagaggaggaaagagtcatatcttcagtaatttcagtctcaatgagctcaaacccacccacattatatgaacttgaaaaaataacatttacattaagtcatcgaaaggtcacagataggtataggagtctatgtgcattttggaattactcacctgataccatgaatggcagctggtcttcagagggctgtgagctgacatactcaaatgagacccacacctcatgccgctgtaatcacctgacacattttgcaattttgatgtcctctggtccttccattggtattaaagattataatattcttacaaggatcactcaactaggaataattatttcactgatttgtcttgccatatgcatttttaccttctggttcttcagtgaaattcaaagcaccaggacaacaattcacaaaaatctttgctgtagcctatttcttgctgaacttgtttttcttgttgggatcaatacaaatactaataagctcttctgttcaatcattgccggactgctacactacttctttttagctgcttttgcatggatgtgcattgaaggcatacatctctatctcattgttgtgggtgtcatctacaacaagggatttttgcacaagaatttttatatctttggctatctaagcccagccgtggtagttggattttcggcagcactaggatacagatattatggcacaaccaaagtatgttggcttagcaccgaaaacaactttatttggagttttataggaccagcatgcctaatcattcttgttaatctcttggcttttggagtcatcatatacaaagtttttcgtcacactgcagggttgaaaccagaagttagttgctttgagaacataaggtcttgtgcaagaggagccctcgctcttctgttccttctcggcaccacctggatctttggggttctccatgttgtgcacgcatcagtggttacagcttacctcttcacagtcagcaatgctttccaggggatgttcatttttttattcctgtgtgttttatctagaaagattcaagaagaatattacagattgttcaaaaatgtcccctgttgttttggatgtttaaggtaaacatagagaatggtggataattacaactgcacaaaaataaaaattccaagctgtggatgaccaatgtataaaaatgactcatcaaattatccaattattaactactagacaaaaagtattttaaatcagtttttctgtttatgctataggaactgtagataataaggtaaaattatgtatcatatagatatactatgtttttctatgtgaaatagttctgtcaaaaatagtattgcagatatttggaaagtaattggtttctcaggagtgatatcactgcacccaaggaaagattttctttctaacacgagaagtatatgaatgtcctgaaggaaaccactggcttgatatttctgtgactcgtgttgcctttgaaactagtcccctaccacctcggtaatgagctccattacagaaagtggaacataagagaatgaaggggcagaatatcaaacagtgaaaagggaatgataagatgtattttgaatgaactgttttttctgtagactagctgagaaattgttgacataaaataaagaattgaagaaacacattttaccattttgtgaattgttctgaacttaaatgtccactaaaacaacttagacttctgtttgctaaatctgtttctttttctaatattctaaaaaaaaaaaaaaggtttacctccacaaattgaaaaaaaaaaaaaaaaaaaaaaaaaaaaaaaaaaaaaaaaaaaaaaaa

SEQ ID NO: 10 - DNA, 925 bp, Homo sapiens
atgggcaaaggcttccctggaatctcccacactgtctgctccctataaaaggcaggcagatgggccagaggagcagagaggctgagaccaacccagaaaccaccacctctcacgccaaagctcacaccttcagcctccaacatgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatttttttttttaaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggaatacataaagtatgtgcatattttattatagtcactagttgtaatttttttgtgggaaatccacactgagctgaggggg

SEQ ID NO: 11 - DNA, 2753 bp, Homo sapiens
gtcgggggcagcagcaagatgcgaagcgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatatattctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatccgtctttcccacttttgttgatgtttatttcagaatcttgtgtgattcatttcaagcaacaacatgttgtattttgttgtgttaaaagtacttttcttgatttttgaatgtatttgtttcaggaagaagtcattttatggatttttctaacccgtgttaacttttctagaatccaccctcttgtgcccttaagcattactttaactggtagggaacgccagaacttttaagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaag

SEQ ID NO: 12 - DNA, 581 bp, Homo sapiens
  misc_feature (509)..(509): n is a, c, g, or t
  misc_feature (537)..(537): n is a, c, g, or t
  misc_feature (564)..(564): n is a, c, g, or t
tgtcaaatctcatctctgttctcctagttttcacagaaatatttacaggaataaaggttgaaacaaaagtacctaatgatcatctccatccatcgaaagattgctcagggataagacactcaaacaagggcttgtgatgaggatggaaaagacaaagcaacttgaagagaaaaaaaaattcttttaaactcagttcatcctgcaaaatggacataacacatgcatataaaggtttgactttttaattccacttttttgcctgatcgcagggaagatggcatgtggctggcccttcctgaagccttgctcctccaccactggctaacagacaggcctccaggtggccttgcaaggccggacagtggaccgcagccccacttccccacatcctttaatcagagcctccatgcagttcatccccacattacccaaacataacgtcgtagtgctacacgtagatgtggttgcatcatgatgctatggcaatgacgatgacgcctaggtgtgtnggccccgaaggcagagaccagatgtggntggtcttgcctggaagccaagctgttnagcaggggtggagtccc

SEQ ID NO: 13 - DNA, 5723 bp, Homo sapiens
cggcgaacagacgttctttctcctccatgcagttacacaaaaggagggctacggaaactaaaagtttcggggcctctggctcggtgtgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtaaaaaaaaaaaaaaaaaa

SEQ ID NO: 14 - DNA, 5222 bp, Homo sapiens
ttctgcccgccgccgccgctgccgagcgccgcctttgttccctgcaggaagggcgagcgcgcgggccagcgctcagccagcgcctcacgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagggtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaagctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttacgagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagtttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccagattctgccactgcatccttcagacagttatatcctccttttaaaccattgttgttgagtgtaagatgtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaatttttatatttttacacaatcatattttagtatggtgtctgtttatgtaactctgacttgctggaaaagttgaaactccaaataatctgaaactagaaaagaaatagcacataattactaccttccccttggcggctctcctcccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccggg

SEQ ID NO: 15 - DNA, 7390 bp, Homo sapiens
gaattccgctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtttggactgcagcgagaagaggtgtcctgctgactgtcacaatcgtggccgctgtgtagacgggcggtgtgagtgtgatgatggtttcactggagctgactgcggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccggggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggaacctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacatgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtcctctggcttcacccaagggcatcaaacaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattcctgcactggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtatttttttttttaaataaaagcacaagtacttttgagtttgttaaaacggaattc

SEQ ID NO: 16 - DNA, 561 bp, Homo sapiens
gacattttacaggttaatgactgttggagaggagaataaaatcaaaactgcaagaacccatttttgtcttcataagcattgcattttaaaatacgagggcttgaagacttctcagaagagacactcactactggagttaaagttatatgaagtccctgagcccttaatcatccaagactggacctaagcagtcctcttcgtttgtagtctctttcaatatctgcttatcaaggacaacgagaatatcttagtctactaattaatcttttttatcaccatagtctaccaagaaagaaagctgataagataataaagatgattcattcctcagagtaggaaaaaaaaaaaaaaaagtcgacgcggccgcgaatttagtagtagtagtcgacccgggaattccggaccggtacctgcaggcgtaccaactttccctatagtgagtcgtattaaagtttggcgtaatatggccattcttgtttcctggggaaattggtttccggttacaatttcccacaacattccgaccccggagcataaagtgtaaaacctggggggcctaat

SEQ ID NO: 17 - DNA, 4500 bp, Homo sapiens
tctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaagcatgccaccctggtttttacgggccagattgtaagcttaggtgcagctgcaacaatggggagatgtgtgatcgcttccaaggatgtctctgctctccaggatggcaggggctccagtgtgagagagaaggcataccgaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcggctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagagcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccatcatctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtgaaagtaaaatattgttaataaacctaacaatgaccctgatagtacaggttaagtgagagaactatatgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcacgtctcaaaaaaaaaaaaaaaaaaaaaaaaaaaaaaaaaaaaaaaaaaaaaaaaaaaaaaaaaaa

SEQ ID NO: 18 - DNA, 760 bp, Homo sapiens
gaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaaaaaaaaaaaaa

SEQ ID NO: 19 - DNA, 2381 bp, Homo sapiens
ttccactgaagtggccaagggagttgagctgagcagggggaggggaagatctacacccatcccccttcctctagccctccctgcgtttagattcagttgcaccttttattattttaactcttctccttaggacacgcagcccccaatttgtccctccggcctgggcggcccctggtcccgcgcgccagcatgggagagcgagggacctgcccgcggcccgccggcgtgtgcaaggaggtccagccgccgcgcccgctacccggagtctgaggacgggtgtccagggacggagaggcaggtgagagggaggtggctaagctggctatggtgacaggacgatgttggccagaaagagtatcatcccggaggagtatgtgctggcgcgcatcgccgcagagaacctgcgcaagccgcgcatccgagaccgcctccccaaagcccgcttcatcgccaagagcggggcctgcaacctggcgcataagaacatccgtgagcaaggacgctttctacaggacatcttcaccaccttggtggacctgaaatggcgccacacgctggtcatctttaccatgtccttcctctgcagctggctgctcttcgctatcatgtggtggctggtggcctttgcccatggggacatctatgcttacatggagaaaagtggaatggagaaaagtggtttggagtccactgtgtgtgtgactaatgtcaggtctttcacttctgcttttctcttctccattgaagttcaagttaccattgggtttggagggaggatgatgacagaggaatgccctttggccatcacggttttgattctccagaatattgtgggtttgatcatcaatgcagtcatgttaggctgcattttcatgaaaacagctcaggctcacagaagggcagaaactttgattttcagccgccatgctgtgattgccgtccgaaatggcaagctgtgcttcatgttccgagtgggtgacctgaggaaaagcatgatcattagtgcctctgtgcgcatccaggtggtcaagaaaacaactacacctgaaggggaggtggttcctattcaccaactggacattcctgttgataacccaatcgagagcaataacatttttctggtggcccctttgatcatctgccacgtgattgacaagcgcagtcccctgtatgacatctcagcaactgacctggccaaccaagacttggaggtcatagttattctggaaggagtggttgaaactactggcatcaccacacaagcacgaacctcctacattgctgaggagatccaatggggccaccgctttgtgtccattgtgactgaggaagaaggagtgtattctgtggattactccaaatttggcaacactgttaaagtagctgctccacggtgcagtgcccgagagctggatgagaaaccttccatccttattcagaccctccaaaagagtgaactgtctcatcaaaattctctgaggaagcgcaactccatgagaagaaacaattccatgaggaggaacaattctatccgaaggaacaattcttccctcatggtaccaaaggtgcaatttatgactccagaaggaaatcaaaacacatcggaatcatgacagcaagataaccccaagacagtcttttatcaagttttgacggtttatgctgggcactgccagactgaaccagagctggaacacaataatgtgtccttctacattttattacactaaatgatattcatattcaagcaacagcactttctgtagtaataaaaagtaacacaccaagtggaggattcatggcttatgcttgtttcatacatgtagaattcgcagtgatatacttaagttatgtgcaggggtgggtatgctcgtttctctcaatttgaaacacaagaattacactaatagtaacaggccttgagcacaaaatttggtcaagaaatgagtctgtttgaaatgcttagttggtgaaacccagatcgctgtgttactaatgatcactctggaaatgcaaatagaataggaggggaaaaaacaaaatcatgttaatgcgttttgtacatcagccttctcctgtctccatgataactgcatttggtaggaagcctgaggcaaaaactgcttaagtggatctgtttgtaagtggattcagttcattcgctttgtctgtcggtgactcctgaaggtttcctggtccatctcattgcggcctgttgggcagagctggacaaggtgtctttgaaggaaagctaagtcttgtctcatttaggactgggttccccacagtgacagtcacttccttcagcatctcacttcttcttctagaatccccacagggaaatactgtattgaatattttattaaaacattttctttgta

SEQ ID NO: 20 - DNA, 884 bp, Homo sapiens
cagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcctgagcccggttctggggcgaaaatgcctgcccttcacatcgaagatttgccagagaaggaaaaactgaaaatggaagttgagcagcttcgcaaagaagtgaagttgcagagacaacaagtgtctaaatgttctgaagaaataaagaactatattgaagaacgttctggagaggatcctctagtaaagggaattccagaagacaagaacccctttaaagaaaaaggcagctgtgttatttcataaataacttgggagaaactgcatcctaagtggaagaactagttgttttagttttcccagataaaaccaacatgctttttaaggaaggaagaatgaaattaaaaggagactttcttaagcaccatatagatagggttatgtataaaagcatatgtgctactcatctttgctcactatgcagtcttttttaagagagcagagagtatcagatgtacaattatggaaataagaacattacttgagcatgacacttctttcagtatattgcttgatgcttcaaataaagttttgtcttgggaaaaaaaaaaaaaaaa

SEQ ID NO: 21 - DNA, 4966 bp, Homo sapiens
gtagatgcagtccgccgccgccgctgcctcagccagcaatgcaagattagatctctaaatgcagcaaaacactgcctgaaaacagaccggcccgcgcagcaagcagacatttcacggtgcgctggggaagcttcaaaatatatctgtgactctgtcttcgttgctcttcatccccatcaatttcatcacgggaggcgagcagcaagtaagaatttcactttcggatctgcctagagacacacctccctgctccctcccccactcgatgtgaagagtattccggagtctccgggcgggagtagatttgcagcaccctagcgggagcgaggaaaacctactgattctttagctcattatcatctctcccagacgagatttccttcttatcgcctgcctcatcgctcaagtttgagcctcccgaagtccgggcgggagagacgaaacccctggctcacccccagccgcaggaagccaccgccttgctccaagcccctgcagctctgctgcaccgcagcttctcacccagtgcggatgctgtagatcaacaggttcagggaacttgagcagaataaggagagaccaccgggtgccgcagctcgggtgcagagggaaaaaaggacccatagacttgtggctcgcgtcgcgcgcgcacgctgcgccagggccccaggctggcgcgcactccctctctggctcctccagtccgattgctcctgcccccaccttacaggtctgggatgtacctttccatctgttgctgctttcttctatgggcccctgccctcactctcaagaacctcaactactccgtgccggaggagcaaggggccggcacggtgatcgggaacatcggcagggatgctcgactgcagcctgggcttccgcctgcagagcgcggcggcggagggcgcagcaagtcgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaacgacaaggagatctgcatgatcaaggtagagatccaggacatcaacgacaacgcgccctccttctcctcggaccagatcgaaatggacatctcggagaacgctgctccgggcacccgcttccccctcaccagcgcacatgaccccgacgccggcgagaatgggctccgcacctacctgctcacgcgcgacgatcacggcctctttggactggacgttaagtcccgcggcgacggcaccaagttcccagaactggtcatccagaaggctctggaccgcgagcaacagaatcaccatacgctcgtgctgactgccctggacggtggcgagcctccacgttccgccaccgtacagatcaacgtgaaggtgattgactccaacgacaacagcccggtcttcgaggcgccatcctacttggtggaactgcccgagaacgctccgctgggtacagtggtcatcgatctgaacgccaccgacgccgatgaaggtcccaatggtgaagtgctctactctttcagcagctacgtgcctgaccgcgtgcgggagctcttctccatcgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgaccgggactctggcaagaacggacagctgcagtgtcgggtcctaggcggaggagggacgggcggcggcgggggcctgggcgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgggacatgtcgctgccgctcatcgtgactctgagcactatctccatcatcctcctagcggccatgatcaccatcgccgtcaagtgcaagcgcgagaacaaggagatccgcacttacaactgccgcatcgccgagtacagccacccgcagctgggtgggggcaagggcaagaagaagaagatcaacaaaaatgatatcatgctggtgcagagcgaagtggaggagaggaacgccatgaacgtcatgaacgtggtgagcagcccctccctggccacctcccccatgtacttcgactaccagacccgcctgcccctcagctcgccccggtcggaggtgatgtatctcaaaccggcctccaacaacctgactgtccctcaggggcacgcgggctgccacaccagcttcaccggacaagggactaatgcaagcgagacccctgccactcggatgtccataattcagacagacaattttcccgcagagcccaattacatgggcagcaggcagcagtttgttcaaagtatttcagtagctccacgtttaaggacccagaaagagccagcctgagagacagtgggcacggggacagtgatcaggctgacagtgaccaagacactaacaaaggctcctgctgtgacatgtctgttagggaggcactcaagatgaaaactacttcaactaaaagccaaccacttgaacaagaaccagaagagtgtgttaattgcacagatgaatgccgagtgcttggtcattctgacaggtgctggatgccacagttccctgcagccaatcaggctgaaaatgcagattaccgcacaaatctctttgtacctacagttgaagctaatgttgagactgagacttacgaaactgtgaatcccactgggaaaaagactttttgtacatttggaaaagacaagcgagagcacactattctcattgccaacgttaaaccttatttaaaagccaaacgtgccctgagccctctcctccaagaggtcccctcagcatcaagcagcccaaccaaggcgtgcatcgagccttgcacctcaacaaaaggctccctggatggctgtgaagcaaaaccaggagccctggctgaagcaagcagtcagtacttgcccactgacagtcaatatctgtcacctagtaagcaaccaagagaccctcccttcatggcttccgatcagatggcaagggtctttgcagatgtgcattccagagccagccgggattccagtgagatgggtgctgttcttgagcagcttgaccaccccaacagggatctgggcagagagtctgtggatgcagaggaagttgtgagagaaattgataagcttttgcaagactgccggggaaacgaccctgtggctgtgagaaagtgaaaaaagaaaaaaaaaaaggcattggcattttcttgtctcttctgttgatttaaaaatgatccctcctggtgataacccattttacagggatgaagaaagaccaatgctgctttaaggcttttagtgaacatctgaagtgcccacaagtatgttctttccactgctgatttctttttcagagataacaatggtttcgttttgaccaaacttgtattaggacagaattaatgatgcttaaagagaaaagaaaaaaagagagaagaaaaaggagagatgaaaaaggaggatgaggagaagaattaccttttgacaatctgttaggaaggtatgcagtgtgagaactgaagtatttctgatcactctcagactgtcctccgtgatttatgctgacttaactgtttacctataaaccccatacaaagcagggtcataatttgtgatctgtggtggatttctagcagtcatcacaggcttctactgaaagtcctgaaaagaccttgcagtagtccaagctacaccaaacattaacacatatttgtggtaaacatttctgtataaagttacctgacacacatataaacacaaggaacattccatatcattagtcgaaaacaaaaacaaaaaaaaaacctttggtcatttgtaagacatctcatgtcatataaaagttaaatgtaaaaagatacagtccattttgtcctgcacacacgtagactaattcacgtcaaaaaaaaaaaaaaa

SEQ ID NO: 22 - DNA, 587 bp, Homo sapiens
tttttttttttttttttgcaaagagcaaaggtcaaatttatttaatacaacatccacgagggtccctgcagctgtgtcactgaggcaaacaggaaaagtgattttggctaggcgtggttctcatctgtgaaattccacagcgcaatgacagcagcctctctcccacccactcaagacactgtcaggaatgtcttaagacctcaggagaccacttctttagcaagcaattttgttttttgttttttttgagatggattctcactctgtcactcaggctggagtgcagtggcgcgatctccgctcactacaacctccgtttcctgggttcaagcgataatctcacctcagcctcttgagtagctgataccacaggcatgcgccaccacgcccggctaattcttgtatttttagtagagacagggtttcatcaggctggtctcaaactcctgacctcaggtgatccgcccacctcagcctcctgaagtgctgggattacaggcgtgagccaacttgcctgccctggcaaggaatacatttttaaaaattagtaagaaacatacacatttcaagttttcaattaagaataa

SEQ ID NO: 23 - DNA, 3310 bp, Homo sapiens
gacctcgtgaaataaaagtgcagaaaacaaacccaggcgatcacagcagcagccgccgcggcagcagcaccaacagcaggaggagcaggaggagccggaggaggaggaggaggaggaggcaaagttagagttggggctggcgctccggagttgctgggctcagcgcagctcccattcattaaggaaccagctgcggaggaaggtggccgagcgcccgcgctgcccactcgctcgctcgcgcactcagacgcgcgccacaacagcgcgccccaagctgcgcagctctgcaaaagtttctgctcgggatctggctctcttccccttggactttagaacgatttagggttgacagaggaaagcagaggcgcgcaggaggagcagaaaacaccaccttctgcagttggaggcaggcagccccggctgcactctagccgccgcgcccggagccggggccgacccgccactatccgcagcagcctcggccaggaggcgacccgggcgcctgggtgtgtggctgctgttgcgggacgtcttcgcggggcgggaggctcgcgccgcagccagcgccatgcaaaactacaagtacgacaaagcgatcgtcccggagagcaagaacggcggcagcccggcgctcaacaacaacccgaggaggagcggcagcaagcgggtgctgctcatctgcctcgacctcttctgcctcttcatggcgggcctccccttcctcatcatcgagacaagcaccatcaagccttaccaccgagggttttactgcaatgatgagagcatcaagtacccactgaaaactggtgagacaataaatgacgctgtgctctgtgccgtggggatcgtcattgccatcctcgcgatcatcacgggggaattctaccggatctattacctgaagaagtcgcggtcgacgattcagaacccctacgtggcagcactctataagcaagtgggctgcttcctctttggctgtgccatcagccagtctttcacagacattgccaaagtgtccatagggcgcctgcgtcctcacttcttgagtgtctgcaaccctgatttcagccagatcaactgctctgaaggctacattcagaactacagatgcagaggtgatgacagcaaagtccaggaagccaggaagtccttcttctctggccatgcctccttctccatgtacactatgctgtatttggtgctatacctgcaggcccgcttcacttggcgaggagcccgcctgctccggcccctcctgcagttcaccttgatcatgatggccttctacacgggactgtctcgcgtatcagaccacaagcaccatcccagtgatgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagtagaatgtagggaaaaacttttgcccgactgatttttaaaaaggaaaaaaaaaatgttttactatgtggccttccaaaataggtagtgtttgcctatgtggaaacaacagcaaactaacaccaagtgccagagtcctggatgtgcaattggtttaagtgttcatgttctagtgaacacagcttgttcaggaacaaacactaaaacgatttgagtagaggctgctggtcaccttttgtgacctgaggaatcccaggcctgtgagaaaagcaaaaattcacattgcagcacatgatgccagaaatagcactgaatcaagaaaatagccattgcggagctgccctcttgagtctttctgtccatcccattctattctgtactgtgactttagttcaggaagttttgttttgtgttttaaataaaaggaaagagcaagtttgctcagtcaagtgatcagatcccgaatctagattcccagttctaaggccttatcacctcccctgcccataggccaacaaccatagttcctcacattagtgattagcagactctttgtggacgagtgaatttcacaaacagcacaatttcagaagaaatcgagggcacaggccctcacttttcttcttttgacgcatcatcctgtgatgttgaaatgtcaattgcaggatgctgatgttgtgcacgtcaatcaccgggcacttgcatactcttagaaacagttcgacttcggttactgccttctcccttgaaatccttgctgcgtgcccaccaggatttcctgtgagggcccaggaatgagcaaggcatggtctgccaccagctgacggaaagcagccttctgtacaacagatgggagggtgaagggggcagaatgaaaatcgaaccaaccttttagctgttgcaaatcagaaggagccagagaagcaggcagtctcatgcatgagaggttacccttcaggatgacagagctgagggtctttgtaggagttgctcttgctgtgtaaagcactattgtcttggggttgagccctagggcagttcttggtaggttctgctgggcagaacatatgggttaaatctcggtagagagtttccctcatcctctatccgtaagtgtccttccatgcaaggtcccactctaggtgatagacagggaccccttctactgaacctttgaggaaaggaggaaggaagaaatgcgtttagatcttggatgcagacctttcaaagggttaaatgtaaccatatggatcaaccacatgcacatccttactacagaatccgtcctttcatttcaacttatagcaagctatgatttttatatataaatattatataaataatgtataaaacattaaaagttaactatgtaagatattatttctgaaacaatttagctatatccactatgattataaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttttaaataaaagctcgtaacacaactaaaaaaaaaaaaaaaaaa

SEQ ID NO: 24 - DNA, 3189 bp, Homo sapiens
tttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctaacaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcggaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacatacactccttccaccaagttggaacatccttggaaattggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacacggttcattcaggcaacgcacaaaacagaaaatgaaggtggaacaagcacagatgttcttcaactgtttttgtctacactctttctcttttcctctaccatgctgaaggctgaaagacaggaagatggtgccatcagcaaatattattcttaattgaaaacttgaaaaaaaaaaaaaaaa

SEQ ID NO: 25 - DNA, 5480 bp, Homo sapiens
cgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagaagtctgccatcaagaagatccgcaaccccaaggggcctctcatcctgcgcctgggggcggcccccgtgacccagcccacgcgacgagtattccctcggggtctcccggaggagtttgccctggtgctgacactactgctgaagaaacacacccaccagaagacgtggtatctgtttcaagtgaccgatgcaaatgggtatccacagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcgtttgaccttcagcaggtgcacatctactgtgacccggagctcgtgctggaggagggctgctgtgagattttaccagcagggtgccccccagagacctccaaggcccgccgggacacccagagcaatgagctcattgagatcaatccacagtctgaaggcaaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatgtcacacttgctccctctggccccaagggagggaaaggtgagcggggcctgcctggtccaccaggctccaagggagagaagggagcacggggcaatgactgtgttcgaatctccccggatgccccgcttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacgggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtacgagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccgggcccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacccgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtgctccgggactttggatgggcagctcctggcagccgggcccgcagggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttaccgggcccaccgggtcccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttttttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaagggcatttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctccttaaaaaaaaaaaaaaaaaaa

SEQ ID NO: 26 - DNA, 3791 bp, Homo sapiens
tttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaaaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgcttttttc

SEQ ID NO: 27 - DNA, 3189 bp, Homo sapiens; identical to SEQ ID NO: 24

SEQ ID NO: 28 - DNA, 1312 bp, Homo sapiens
gagcgtgacccagctgcggccggccagccatggagactggagcgctgcggcgcccgcaacttctcccgttgctgctgctgctctgcggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctgtgagggtcccggtgagatggagtgggtcacacctggcaagctggaagaaagttccctggggatgggagatcgggtgggtgctgccaatctccagctactgtggccacaccccacctggtcatgggcagacccctcccttcctgggctgacctgctccctcgaggccagcctgctccctggctgaggctcaggctatccgcccaagctctttgctcattctagggccagtggaggaaaatgtgataaggccagagcttgtgtgctgggcaagaaatcacctgctgcatcctgtgctccgcaggctgggccggaagcctctgcctgcaggtttctatgctgtttcttagcacagaatccagcctagccttagccgcagtctaggccctgcttggactaggactccttgcttgaccccatctctggttcctgccctggctcctgcaccagccccagctcctgcctacatccaggcagaaatataggcaggggctcttggaagacgttccgtgctgtgacctccgagccctcctggtgggaagacagctggaaaggctgggaggagaagggaggggctgggggttcccaggagccatgcgtggcctgcagagtccattccatcatgatgctgtgcccgctatgggctgtgtccatgaccagaggctggagtgggggtgtgttatagcccctcaccgggacttgctgtgcggatggggcctgggcctccttcctacaggggctcctctgtgggtgaggggccctctggaatggcatcccatgagcttgtggcctctatctgctaccatctgtgttttatctgagtaaagttaccttacttctgg

SEQ ID NO: 29 - DNA, 3335 bp, Homo sapiens
ggcacgagctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacagaccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctgcccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcaaagggccactgggttaggacctgaggacctcacttggccctgcaaggcccgcttttcagggaccagtccaccaccatctcctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagctacgggtgtgtgtgtctgtctatgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaaaaaaaaaaaaaaaa

SEQ ID NO: 30 - DNA, 2500 bp, Homo sapiens
cggggggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcggagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggc

SEQ ID NO: 31 - DNA, 3332 bp, Homo sapiens
acttggctctcgccctccggccgggaagcatggggcttcccaggctggtctgcgccttcttgctcgccgcctgctgctgctgtcctcgcgtcgcgggtgtgcccggagaggctgagcagcctgcgcctgagctggtggaggtggaagtgggcagcacagcccttctgaagtgcggcctctcccagtcccaaggcaacctcagccatgtcgactggttttctgtccacaaggagaagcggacgctcatcttccgtgtgcgccagggccagggccagagcgaacctggggagtacgagcagcggctcagcctccaggacagaggggctactctggccctgactcaagtcaccccccaagacgagcgcatcttcttgtgccagggcaagcgccctcggtcccaggagtaccgcatccagctccgcgtctacaaagctccggaggagccaaacatccaggtcaaccccctgggcatccctgtgaacagtaaggagcctgaggaggtcgctacctgtgtagggaggaacgggtaccccattcctcaagtcatctggtacaagaatggccggcctctgaaggaggagaagaaccgggtccacattcagtcgtcccagactgtggagtcgagtggtttgtacaccttgcagagtattctgaaggcacagctggttaaagaagacaaagatgcccagttttactgtgagctcaactaccggctgcccagtgggaaccacatgaaggagtccagggaagtcaccgtccctgttttctacccgacagaaaaagtgtggctggaagtggagcccgtgggaatgctgaaggaaggggaccgcgtggaaatcaggtgtttggctgatggcaaccctccaccacacttcagcatcagcaagcagaaccccagcaccagggaggcagaggaagagacaaccaacgacaacggggtcctggtgctggagcctgcccggaaggaacacagtgggcgctatgaatgtcagggcctggacttggacaccatgatatcgctgctgagtgaaccacaggaactactggtgaactatgtgtctgacgtccgagtgagtcccgcagcccctgagagacaggaaggcagcagcctcaccctgacctgtgaggcagagagtagccaggacctcgagttccagtggctgagagaagagacaggccaggtgctggaaagggggcctgtgcttcagttgcatgacctgaaacgggaggcaggaggcggctatcgctgcgtggcgtctgtgcccagcatacccggcctgaaccgcacacagctggtcaacgtggccatttttggccccccttggatggcattcaaggagaggaaggtgtgggtgaaagagaatatggtgttgaatctgtcttgtgaagcgtcagggcacccccggcccaccatctcctggaacgtcaacggcacggcaagtgaacaagaccaagatccacagcgagtcctgagcaccctgaatgtcctcgtgaccccggagctgttggagacaggtgttgaatgcacggcctccaacgacctgggcaaaaacaccagcatcctcttcctggagctggtcaatttaaccaccctcacaccagactccaacacaaccactggcctcagcacttccactgccagtcctcataccagagccaacagcacctccacagagagaaagctgccggagccggagagccggggcgtggtcatcgtggctgtgattgtgtgcatcctggtcctggcggtgctgggcgctgtcctctatttcctctataagaagggcaagctgccgtgcaggcgctcagggaagcaggagatcacgctacccccgtctcgtaagagcgaacttgtagttgaagttaagtcagataagctcccagaagagatgggcctcctgcagggcagcagcggtgacaagagggctccgggagaccagggagagaaatacatcgatctgaggcattagccccgaatcacttcagctcccttccctgcctggaccattcccagctccctgctcactcttctctcagccaaagcctccaaagggactagagagaagcctcctgctcccctcgcctgcacaccccctttcagagggccactgggttaggacctgaggacctcacttggccctgcaaggcccgcttttcagggaccagtccaccaccatctcctccacgttgagtgaagctcatcccaagcaaggagccccagtctcccgagcgggtaggagagtttcttgcagaacgtgttttttctttacacacattatggctgtaaatacctggctcctgccagcagctgagctgggtagcctctctgagctggtttcctgccccaaaggctggcttccaccatccaggtgcaccactgaagtgaggacacaccggagccaggcgcctgctcatgttgaagtgcgctgttcacacccgctccggagagcaccccagcagcatccagaagcagctgcagtgttgctgccaccaccctcctgtctgcctcttcaaagtctcctgtgacattttttctttggtcagaagccaggaactggtgtcattccttaaaagatacgtgccggggccaggtgtggtggctcacgcctgtaatcccagcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagatacgtgcctgcggtgaggaagctgggcgctgttttcgagttcaggtgaattagcctcaatcccccgtgttcacttggctcccatagccctcttgatggatcacgtaaaactgaaaggcagcggggagcagacaaagatgaggtctacactgtccttcatggggattaaagctatggttatattagcaccaaacttctacaaaccaagctcagggccccaaccctagaagggcccaaatgagagaatggtacttagggatggaaaacgggcctggctagagcttcgggtgtgtgtgtctgtctgtgtgtatgcatacatatgtgtgtatatatggttttgtcaggtgtgtaaatttgcaaattgtttcctttatatatgtatgtatatatatatatgaaaatatatatatatatgaaaaataaagcttaattgtcccagaaatcata

SEQ ID NO: 32 - DNA, 2443 bp, Homo sapiens
aaatggcgtgcccgtctctccgccggccccctgcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatccccagtgaaaaaaaa

SEQ ID NO: 33 - DNA, 2317 bp, Homo sapiens
cggacgcgtgggtgagcagggacggtgcaccggacggcgggatcgagcaaatgggtctggccatggagcacggagggtcctacgctcgggcggggggcagctctcggggctgctggtattacctgcgctacttcttcctcttcgtctccctcatccaattcctcatcatcctggggctcgtgctcttcatggtctatggcaacgtgcacgtgagcacagagtccaacctgcaggccaccgagcgccgagccgagggcctatacagtcagctcctagggctcacggcctcccagtccaacttgaccaaggagctcaacttcaccacccgcgccaaggatgccatcatgcagatgtggctgaatgctcgccgcgacctggaccgcatcaatgccagcttccgccagtgccagggtgaccgggtcatctacacgaacaatcagaggtacatggctgccatcatcttgagtgagaagcaatgcagagatcaattcaaggacatgaacaagagctgcgatgccttgctcttcatgctgaatcagaaggtgaagacgctggaggtggagatagccaaggagaagaccatttgcactaaggataaggaaagcgtgctgctgaacaaacgcgtggcggaggaacagctggttgaatgcgtgaaaacccgggagctgcagcaccaagagcgccagctggccaaggagcaactgcaaaaggtgcaagccctctgcctgcccctggacaaggacaagtttgagatggaccttcgtaacctgtggagggactccattatcccacgcagcctggacaacctgggttacaacctctaccatcccctgggctcggaattggcctccatccgcagagcctgcgaccacatgcccagcctcatgagctccaaggtggaggagctggcccggagcctccgggcggatatcgaacgcgtggcccgcgagaactcagacctccaacgccagaagctggaagcccagcagggcctgcgggccagtcaggaggcgaaacagaaggtggagaaggaggctcaggcccgggaggccaagctccaagctgaatgctcccggcagacccagctagcgctggaggagaaggcggtgctgcggaaggaacgagacaacctggccaaggagctggaagagaagaagagggaggcggagcagctcaggatggagctggccatcagaaactcagccctggacacctgcatcaagaccaagtcgcagccgatgatgccagtgtcaaggcccatgggccctgtccccaacccccagcccatcgacccagctagcctggaggagttcaagaggaagatcctggagtcccagaggccccctgcaggcatccctgtagccccatccagtggctgaggaggctccaggcctgaggaccaagggatggcccgactcggcggtttgcggaggatgcagggatatgctcacagcgcccgacacaaccccctcccgccgcccccaaccacccagggccaccatcagacaactccctgcatgcaaacccctagtaccctctcacacccgcacccgcgcctcacgatccctcacccagagcacacggccgcggagatgacgtcacgcaagcaacggcgctgacgtcacatatcaccgtggtgatggcgtcacgtggccatgtagacgtcacgaagagatatagcgatggcgtcgtgcagatgcagcacgtcgcacacagacatggggaacttggcatgacgtcacaccgagatgcagcaacgacgtcacgggccatgtcgacgtcacacatattaatgtcacacagacgcggcgatggcatcacacagacggtgatgatgtcacacacagacacagtgacaacacacaccatgacaacgacacctatagatatggcaccaacatcacatgcacgcatgccctttcacacacactttctacccaattctcacctagtgtcacgttcccccgaccctggcacacgggccaaggtacccacaggatcccatcccctcccgcacagccctgggccccagcacctcccctcctccagcttcctggcctcccagccacttcctcacccccagtgcctggacccggaggtgagaacaggaagccattcacctccgctccttgagcgtgagtgtttccaggaccccctcggggccctgagccgggggtgagggtcacctgttgtcgggaggggagccactccttctcccccaactcccagccctgcctgtggcccgttgaaatgttggtggcacttaataaatattagtaaatccttaaaaaaaaaaaaaaaaaaaaaaaaaaaaaaa

SEQ ID NO: 34 - DNA, 6511 bp, Homo sapiens
gaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgctggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcataccttaaaaaaaaaaaaaaaaaa

SEQ ID NO: 35 - DNA, 4047 bp, Homo sapiens
gggtgtgctgggggactgtgcagctcgaggctccagaggcacactccagagagagccaaggttctgacgcgatgaggaagcacctgagctggtggtggctggccactgtctgcatgctgctcttcagccacctctctgcggtccagacgaggggcatcaagcacagaatcaagtggaaccggaaggccctgcccagcactgcccagatcactgaggcccaggtggctgagaaccgcccgggagccttcatcaagcaaggccgcaagctcgacattgacttcggagccgagggcaacaggtactacgaggccaactactggcagttccccgatggcatccactacaacggctgctctgaggctaatgtgaccaaggaggcatttgtcaccggctgcatcaatgccacccaggcggcgaaccagggggagttccagaagccagacaacaagctccaccagcaggtgctctggcggctggtccaggagctctgctccctcaagcattgcgagttttggttggagaggggcgcaggacttcgggtcaccatgcaccagccagtgctcctctgccttctggctttgatctggctcacggtgaaataagcttgccaggaggctggcagtacagagtgcagcagcgagcaaatcctggcaagtgacccagctcttctcccccaaacccacgcgtgttctgaaggtgcccaggagcggcgatgcactcgcactgcaaatgccgctcccacgtatgcgccctggtatgtgcctgcgttctgatagatgggggactgtggcttctccgtcactccattctcagcccctagcagagcgtctggcacactagattagtagtaaatgcttgatgagaagaacacatcaggcactgcgccacctgcttcacagtacttcccaacaactcttagaggtaggtgtattcccgttttacagataaggaaactgaggcccagagagctgaagtactgcacccagcatcaccagctagaaagtggcagagccaggattcaaccctggcttgtctaaccccaggttttctgctctgtccaattccagagctgtctggtgatcactttatgtctcacagggacccacatccaaacatgtatctctaatgaaattgtgaaagctccatgtttagaaataaatgaaaacacctgagctggtggctgtgtactttgactggtacatggaggctattttaatccttctaactaaactaaaatagattaaaggaattaaactaaaatacaagtaaagctagacaaaggcccagaaatcatactgtaaggaaatgttattggaagctgattcccagagcagaccacatatacagcaggatgtgcctgtggcatgaagattttctttctcttttttttttttttttagatggagttttactcttgttgcccaggctggagtgcaacggcatgattttggctcactgcagcctctgcctcccaggctcaagcacttttcctgtctcagccttccgagtagctgggattacaggtgtgtgccatcatgcctgactaattttgtatttttagtagagacagggtttcaccatgttggccaggctggtcttgaactcctgacctcaggtgatccacccacctgggcctcccatagtgctgggattcaattttttttttttttttttcaaaagaagggtaagtgcttgctgttcccatccctgaaacattgcatgtatttaagaaaaacaaaatgttagtggcatatttgcttctaatgttcccctaaccctacatgcatgttttatgtgcactcatatgagtatctttaaatataatccctttacatctgtgttctatgcaaagtctctcatttctttcaagacagcctaatgaaggccatcatctctgtaaaccacttgtcactacaaaaatacaattactcaccaaaaagctttaaaaaataaagctgtgtctttagggagacccaataaagaatgcaatccatgccataagcaggagttgatacaccaccttattagctaaaaatatatataacacaatatgagtaatgtttaagatctgttttaaatttaaaacaatgaattgaatgctctaagaggctcctacaggcgctccaggccactctcagagactcccaggagttgttgaactatatttggagaaaacagccactgaatattatcatttctcctttaaagagagtttgtaaggggggaacatgcattttatcagacaatttatccaaagcattgcagaacatgagtgctgatgagggcacctcttgtgctgagtcccctcagctatcagtgttcttctcaaggacacatttggaaggttttaacattgaaagtgagcggaggacttgggggcagagcagcacaaagaaacagccttacactgggcacatggaggagacgtccaccctgcagccaggactggggttcacgtcactgccagagctacactcgccttctgcttccacggtcctgttaattctagatcagagagcaagaaaaaagtacagaacatatcctctacggttatttcctgctttctaattaaaaaaataataaccatggcaagagagaaagaaagagaaagtactcagaggctgacactgacatttcacttcctcgctctcctaagtttaattacaacagcacgtgcagccacgtcagccaaatgacttcatttctgatgtgaaaacgcttaggccatgatgtcgttcattttctgtaattgctgccttttctcattctgttaatagtcccggcaaccagatttcagtggggcatgacgtgaatgtgtatatggtgattcaaatgcaaaatttgtttatggggcttttaatcgaacgcgtgtgtgcctgaacattcttgctcaagttgatgaatcatggggtggaataaaggctgagtttagtttttcactttagcaaaggggcaatggggtgcctactatgtgcgagacattgggaggggcttctgaattattctggatatcgtcattttgcagtgtgcataattttgccaaccgttgctttcgtagcccctgctaagtgttgactttttaaaatataagtttattgtaaaagtgacatgaaaattacaacagatattccagaccaaaataatacaacaatcccagcatctgattgagtcagtgtttgctgtttcccctgcactttcctagttcttaagcatttgcgtatgtaaacattcatatttgcaataaaaaagtgagcttttatattctaaatttttacttaacttaattcaatgctttctactcatttttctatacttttttttttgaggcagagtctcattctgttgcccaggctggagtgcagtggcgtgatcttggctcactacaacctccaccttccaggcttaagcgattctcatgcctcatcctcccaagtaggtgggattacaggtgcccaccaccaagccctgcaaatttttttgtatttttagtagagacagtgttttgccatgttggccaggctggtctcgaactcctgacatcaggtgatccacctgcctcggcctcccaaagtgctgggattacaggtgtgagccaccacgccctgcctactctttgttttctttcctccccacccattttcccccgtcctgtcccctccttccagcctgagatgtaggctccaccttaactgtgctcagatacacaagtgagggctttttaacttgattatgccttttaaaaatactatgtatgtaaaatatttattcatctgcaatttggcttccctaacttaacattgcatcatgaaactctttggaacaacagctatctagatagctgactcattcttttggattgctacgtaatctcacttaatacagatgtatcatgattgattgaatcattgccttgttgatgggccttcagattatttccagttttttgccactgcaaacaataaacatccttgtacatactaaaaaaaaaaaaaaaaaaaaaaaaaaaaaaaaaaaaaaaaaaaaaaaaaaaaaaaaaaaaaaaaaaaa

SEQ ID NO: 36 - DNA, 3332 bp, Homo sapiens; identical to SEQ ID NO: 31

SEQ ID NO: 37 - DNA, 1488 bp, Homo sapiens
acattcactacaccttttccatttgctaataaggccctgccaggctgggagggaattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacagaatcattacagaaaaatgttgtcacaccaacaactggaacaactcctaaaggaacaatcaccaatgaattacttaaaatgtctctgatgtcaacagctacttttttaacaagtaaagatgaaggattgaaagccacaaccactgatgtcaggaagaatgactccatcatttcaaacgtaacagtaacaagtgttacacttccaaatgctgtttcaacattacaaagttccaaacccaagactgaaactcagagttcaattaaaacaacagaaataccaggtagtgttctacaaccagatgcatcaccttctaaaactggtacattaacctcaataccagttacaattccagaaaacacctcacagtctcaagtaataggcactgagggtggaaaaaatgcaagcacttcagcaaccagccggtcttattccagtattattttgccggtggttattgctttgattgtaataacactttcagtatttgttctggtgggtttgtaccgaatgtgctggaaggcagatccgggcacaccagaaaatggaaatgatcaacctcagtctgataaagagagcgtgaagcttcttaccgttaagacaatttctcatgagtctggtgagcactctgcacaaggaaaaaccaagaactgacagcttgaggaattctctccacacctaggcaataattacgcttaatctccagcttctatgcaccaagcgtggaaaaggagaaagtcctgcagaatcaatcccgacttccatacctgctgctggactgtaccagacgtctgtcccagtaaagtgatgtccagctgacatgcaataatttgatggaatcaaaaagaaccccggggctctcctgttctctcacatttaaaaattccattactccatttacaggagcgttcctaggaaaaggaattttaggaggagaatttgtgagcagtgaatctgacagcccaggaggtgggctcgctgataggcatgactttccttaatgtttaaagttttccgggccaagaatttttatccatgaagactttcctacttttctcggtgttcttatattacctactgttagtatttattgtttaccactatgttaatgcagggaaaagttgcacgtgtattattaaatattaggtagaaatcataccatgctactttgtacatataagtattttattcctgctttcgtgttacttttaataaataactactgtactcaatactctaaaaaaaaaa

SEQ ID NO: 38 - DNA, 1638 bp, Homo sapiens
tcagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaaaaaaaaaaaaaaaaa

SEQ ID NO: 39 - DNA, 6847 bp, Homo sapiens
  misc_feature (5824)..(5825): n is a, c, g, or t
  misc_feature (6248)..(6248): n is a, c, g, or t
  misc_feature (6252)..(6252): n is a, c, g, or t
  misc_feature (6510)..(6510): n is a, c, g, or t
  misc_feature (6557)..(6557): n is a, c, g, or t
  misc_feature (6564)..(6564): n is a, c, g, or t
  misc_feature (6613)..(6613): n is a, c, g, or t
  misc_feature (6615)..(6615): n is a, c, g, or t
  misc_feature (6626)..(6626): n is a, c, g, or t
  misc_feature (6631)..(6631): n is a, c, g, or t
agccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattggttttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatgggtctctctttaattgaccaaaaccttccatttttctcttaaatacaaagcgatctgtgttctgagcaacctttccccgaacacacagcttcagtgcagcacgctgacctgagtatccaccaggtgccaggcacagttgctgggcnnacggaggcaccaaggtccgggccacctgcccgcaggcaaggcccagctgaggtggtgggaggggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaactcatattggtaagtgattgataaaaattggttggtgttttcatgacatgtggacttctnttgnatagaagtcaaatgtagtgacaatttgtggaagagattcttgtcaaagtgaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaanccaaagggggaagctgactgtgtattaccaaaaaaaattctgtaatncaaaccnaaatgtctgcggaatcaccagtttgatactctctgtaatcagagcagtngnctgagggcggncagtncctgggtgaacgtgtctagcagccactgtgggggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaaaaaaaaaaaaaa

SEQ ID NO: 40 - DNA, 8923 bp, Homo sapiens
agctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaaggcaccattgtccagcagctgagtttcccagggaccttggagatagccgcagccctcatttatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcactggtcaatcccacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacatccagctccccctcctgaaaggtgacctccgcatccagcatacagtgacggcctccgtgcgcctcagctacggggaggacctgcagatggactgggatggccgcgggaggctgctggtgaagctgtcccccgtctacgccgggaagacctgcggcctgtgtgggaattacaatggcaaccagggcgacgacttccttaccccctctgggctggcagagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgcccccccacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgcgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgctgcatgttctgctcttgtgcccttctgagcccacaat

SEQ ID NO: 41 - DNA, 4176 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgataaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggctagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgtgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaatatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctggg

SEQ ID NO: 42 - DNA, 1440 bp, Homo sapiens
cagtcacatttcagccactgctctgagaatttgtgagcagcccctaacaggctgttacttcactacaactgacgatatgatcatcttaatttacttatttctcttgctatgggaagacactcaaggatggggattcaaggatggaatttttcataactccatatggcttgaacgagcagccggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacagatccaaagcaaatttttaaatctccaggcttcccaaatgagtacgaagataaccaaatctgctactggcacattagactcaagtatggtcagcgtattcacctgagttttttagattttgaccttgaagatgacccaggttgcttggctgattatgttgaaatatatgacagttacgatgatgtccatggctttgtgggaagatactgtggagatgagcttccagatgacatcatcagtacaggaaatgtcatgaccttgaagtttctaagtgatgcttcagtgacagctggaggtttccaaatcaaatatgttgcaatggatcctgtatccaaatccagtcaaggaaaaaatacaagtactacttctactggaaataaaaactttttagctggaagatttagccacttataaaaaaaaaaaaaaggatgatcaaaacacacagtgtttatgttggaatcttttggaactcctttgatctcactgttattattaacatttatttattatttttctaaatgtgaaagcaatacataatttagggaaaattggaaaatataggaaactttaaacgagaaaatgaaacctctcataatcccactgcatagaaataacaagcgttaacattttcatatttttttctttcagtcatttttctatttgtggtatatgtatatatgtacctatatgtatttgcatttgaaattttggaatcctgctctatgtacagttttgtattatactttttaaatcttgaactttataaacattttctgaaatcattgattattctacaaaaacatgattttaaacagctgtaaaatattctatgatatgaatgttttatgcattatttaagcctgtctctattgttggaatttcaggtcattttcataaatattgttgcaataaatatccttgaacacaaaaaaaaaaaaaaaaaa

SEQ ID NO: 43 - DNA, 5669 bp, Homo sapiens
gagggagatagcgtgcatccagaaagacaaagacattcctgcggaggatatcatctgtgagtactttgagcccaagcctctcctggagcaggcttgcctcattccttgccagcaagattgcatcgtgtctgaattttctgcctggtccgaatgctccaagacctgcggcagcgggctccagcaccggacgcgtcatgtggtggcgcccccgcagttcggaggctctggctgtccaaacctgacggagttccaggtgtgccaatccagtccatgcgaggccgaggagctcaggtacagcctgcatgtggggccctggagcacctgctcaatgccccactcccgacaagtaagacaagcaaggagacgcgggaagaataaagaacgggaaaaggaccgcagcaaaggagtaaaggatccagaagcccgcgagcttattaagaaaaagagaaacagaaacaggcagaacagacaagagaacaaatattgggacatccagattggatatcagaccagagaggttatgtgcattaacaagacggggaaagctgctgatttaagcttttgccagcaagagaagcttccaatgaccttccagtcctgtgtgatcaccaaagagtgccaggtttccgagtggtcagagtggagcccctgctcaaaaacatgccatgacatggtgtcccctgcaggcactcgtgtaaggacacgaaccatcaggcagtttcccattggcagtgaaaaggagtgtccagaatttgaagaaaaagaaccctgtttgtctcaaggagatggagttgtcccctgtgccacgtatggctggagaactacagagtggactgagtgccgtgtggaccctttgctcagtcagcaggacaagaggcgcggcaaccagacggccctctgtggagggggcatccagacccgagaggtgtactgcgtgcaggccaacgaaaacctcctctcacaattaagtacccacaagaacaaagaagcctcaaagccaatggacttaaaattatgcactggacctatccctaatactacacagctgtgccacattccttgtccaactgaatgtgaagtttcaccttggtcagcttggggaccttgtacttatgaaaactgtaatgatcagcaagggaaaaaaggcttcaaactgaggaagcggcgcattaccaatgagcccactggaggctctggggtaaccggaaactgccctcacttactggaagccattccctgtgaagagcctgcctgttatgactggaaagcggtgagactgggagactgcgagccagataacggaaaggagtgtggtccaggcacgcaagttcaagaggttgtgtgcatcaacagtgatggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtggaattcgctgtccaaatagcagtgctttgcaagaagtacgaagctgtaatgagcatccttgcacagtgtaccactggcaaactggtccctggggccagtgcattgaggacacctcagtatcgtccttcaacacaactacgacttggaatggggaggcctcctgctctgtcggcatgcagacaagaaaagtcatctgtgtgcgagtcaatgtgggccaagtgggacccaaaaaatgtcctgaaagccttcgacctgaaactgtaaggccttgtctgcttccttgtaagaaggactgtattgtgaccccatatagtgactggacatcatgcccctcttcgtgtaaagaaggggactccagtatcaggaagcagtctaggcatcgggtcatcattcagctgccagccaacgggggccgagactgcacagatcccctctatgaagagaaggcctgtgaggcacctcaagcgtgccaaagctacaggtggaagactcacaaatggcgcagatgccaattagtcccttggagcgtgcaacaagacagccctggagcacaggaaggctgtgggcctgggcgacaggcaagagccattacttgtcgcaagcaagatggaggacaggctggaatccatgagtgcctacagtatgcaggccctgtgccagcccttacccaggcctgccagatcccctgccaggatgactgtcaattgaccagctggtccaagttttcttcatgcaatggagactgtggtgcagttaggaccagaaagcgcactcttgttggaaaaagtaaaaagaaggaaaaatgtaaaaattcccatttgtatcccctgattgagactcagtattgtccttgtgacaaatataatgcacaacctgtggggaactggtcagactgtattttaccagagggaaaagtggaagtgttgctgggaatgaaagtacaaggagacatcaaggaatgcggacaaggatatcgttaccaagcaatggcatgctacgatcaaaatggcaggcttgtggaaacatctagatgtaacagccatggttacattgaggaggcctgcatcatcccctgcccctcagactgcaagctcagtgagtggtccaactggtcgcgctgcagcaagtcctgtgggagtggtgtgaaggttcgttctaaatggctgcgtgaaaaaccatataatggaggaaggccttgccccaaactggaccatgtcaaccaggcacaggtgtatgaggttgtcccatgccacagtgactgcaaccagtacctatgggtcacagagccctggagcatctgcaaggtgacctttgtgaatatgcgggagaactgtggagagggcgtgcaaacccgaaaagtgagatgcatgcagaatacagcagatggcccttctgaacatgtagaggattacctctgtgacccagaagagatgcccctgggctctagagtgtgcaaattaccatgccctgaggactgtgtgatatctgaatggggtccatggacccaatgtgttttgccttgcaatcaaagcagtttccggcaaaggtcagctgatcccatcagacaaccagctgatgaaggaagatcttgccctaatgctgttgagaaagaaccctgtaacctgaacaaaaactgctaccactatgattataatgtaacagactggagtacatgtcagctgagtgagaaggcagtttgtggaaatggaataaaaacaaggatgttggattgtgttcgaagtgatggcaagtcagttgacctgaaatattgtgaagcgcttggcttggagaagaactggcagatgaacacgtcctgcatggtggaatgccctgtgaactgtcagctttctgattggtctccttggtcagaatgttctcaaacatgtggcctcacaggaaaaatgatccgaagacgaacagtgacccagccctttcaaggtgatggaagaccatgcccttccctgatggaccagtccaaaccctgcccagtgaagccttgttatcggtggcaatatggccagtggtctccatgccaagtgcaggaggcccagtgtggagaagggaccagaacaaggaacatttcttgtgtagtaagtgatgggtcagctgatgatttcagcaaagtggtggatgaggaattctgtgctgacattgaactcattatagatggtaataaaaatatggttctggaggaatcctgcagccagccttgcccaggtgactgttatttgaaggactggtcttcctggagcctgtgtcagctgacctgtgtgaatggtgaggatctaggctttggtggaatacaggtcagatccagaccggtgattatacaagaactagagaatcagcatctgtgcccagagcagatgttagaaacaaaatcatgttatgatggacagtgctatgaatataaatggatggccagtgcttggaagggctcttcccgaacagtgtggtgtcaaaggtcagatggtataaatgtaacagggggctgcttggtgatgagccagcctgatgccgacaggtcttgtaacccaccgtgtagtcaaccccactcgtactgtagcgagacaaaaacatgccattgtgaagaagggtacactgaagtcatgtcttctaacagcacccttgagcaatgcacacttatccccgtggtggtattacccaccatggaggacaaaagaggagatgtgaaaaccagtcgggctgtacatccaacccaaccctccagtaacccagcaggacggggaaggacctggtttctacagccatttgggccagatgggagactaaagacctgggtttacggtgtagcagctggggcatttgtgttactcatctttattgtctccatgatttatctagcttgcaaaaagccaaagaaaccccaaagaaggcaaaacaaccgactgaaacctttaaccttagcctatgatggagatgccgacatgtaacatataacttttcctggcaacaaccagtttcggctttctgacttcatagatgtccagaggccacaacaaatgtatccaaactgtgtggattaaaatatattttaatttttaaaaatggcatcataaagacaagagtgaaaatcatactgccactggagatatttaagacagtaccacttatatacagaccatcaaccgtgagaattataggagatttagctgaatacatgctgcattctgaaagttttatgtcatcttttctgaaatctaccgactgaaaaaccactttcatctctaaaaaataatggtggaattggccagttaggatgcctgatacaagaccgtctgcagtgttaatccataaaacttcctagcatgaagagtttctaccaagatctccacaatactatggtcaaattaacatgtgtactcagttgaatgacacacattatgtcagattatgtacttgctaataagcaattttaacaatgcataacaaataaactctaagctaagcagaaaatccactgaataaattcagcatcttggtggtcgatggtagattttattgacctgcatttcagagacaaagcctcttttttaagacttcttgtctctctccaaagtaagaatgctggacaagtactagtgtcttagaagaacgagtcctcaagttcagtattttatagtggtaattgtctggaaaactaatttacttgtgttaatacaatacgtttctactttccctgattttcaaactggttgcctgcatcttttttgctatatggaaggcacatttttgcactatattagtgcagcacgataggcgcttaaccagtattgccatagaaactgcctcttttcatgtgggatgaagacatctgtgccaagagtggcatgaagacatttgcaagttcttgtatcctgaagagagtaaagttcagtttggatggcagcaagatgaaatcagctattacacctgctgtacacacacttcctcatcactgcagccattgtgaaattgacaacatggcggtaatttaagtgttgaagtccctaaccccttaaccctctaaaaggtggattcctctagttggtttgtaattgttctttgaaggctgtttatgactagatttttatatttgttatctttgttaag

SEQ ID NO: 44 - DNA, 6297 bp, Homo sapiens
agaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcagtggccgtgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagtaacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagaggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttctttttagcccttttgtttggtctatcagtataagaagaatattttaggtttatagctgaagttatcaaggtttaataaagtaaatttctaaca

SEQ ID NO: 45 - DNA, 3142 bp, Homo sapiens
cctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgacccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtcttgcagaaacagtccattgtgaccttcagcctgtgggccccgagaggggcgaggtgacatataccactagccaggtctcgaagggctgcgtggctcaggcccccaatgccatccttgaagtccatgtcctcttcctggagttcccaacgggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacaattccagcctggtcaccttccaagagcccccgggggtcaacaccacagagctgccatccttccccaagacccagatccttgagtgggcagctgagaggggccccatcacctctgctgctgagctgaatgacccccagagcatcctcctccgactgggccaagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggccactcggccgggccccggacggtgacggtgaaggtggaactgagctgcgcacccggggatctcgatgccgtcctcatcctgcagggtcccccctacgtgtcctggctcatcgacgccaaccacaacatgcagatctggaccactggagaatactccttcaagatctttccagagaaaaacattcgtggcttcaagctcccagacacacctcaaggcctcctgggggaggcccggatgctcaatgccagcattgtggcatccttcgtggagctaccgctggccagcattgtctcacttcatgcctccagctgcggtggtaggctgcagacctcacccgcaccgatccagaccactcctcccaaggacacttgtagcccggagctgctcatgtccttgatccagacaaagtgtgccgacgacgccatgaccctggtactaaagaaagagcttgttgcgcatttgaagtgcaccatcacgggcctgaccttctgggaccccagctgtgaggcagaggacaggggtgacaagtttgtcttgcgcagtgcttactccagctgtggcatgcaggtgtcagcaagtatgatcagcaatgaggcggtggtcaatatcctgtcgagctcatcaccacagcggaaaaaggtgcactgcctcaacatggacagcctctctttccagctgggcctctacctcagcccacacttcctccaggcctccaacaccatcgagccggggcagcagagctttgtgcaggtcagagtgtccccatccgtctccgagttcctgctccagttagacagctgccacctggacttggggcctgagggaggcaccgtggaactcatccagggccgggcggccaagggcaactgtgtgagcctgctgtccccaagccccgagggtgacccgcgcttcagcttcctcctccacttctacacagtacccatacccaaaaccggcaccctcagctgcacggtagccctgcgtcccaagaccgggtctcaagaccaggaagtccataggactgtcttcatgcgcttgaacatcatcagccctgacctgtctggttgcacaagcaaaggcctcgtcctgcccgccgtgctgggcatcacctttggtgccttcctcatcggggccctgctcactgctgcactctggtacatctactcgcacacgcgtgagtaccccaggcccccacagtgagcatgccgggcccctccatccacccgggggagcccagtgaagcctctgagggattgaggggccctggcaggaccctgacctccgcccctgcccccgctcccgctcccaggttcccccagcaagcgggagcccgtggtggcggtggctgccccggcctcctcggagagcagcagcaccaaccacagcatcgggagcacccagagcaccccctgctccaccagcagcatggcatagccccggccccccgcgctcgcccagcaggagagactgagcagccgccagctgggagcactggtgtgaactcaccctgggagccagtcctccactcgacccagaatggagcctgctctccgcgcctacccttcccgcctccctctcagaggcctgctgccagtgcagccactggcttggaacaccttggggtccctccaccccacagaaccttcaacccagtgggtctgggatatggctgcccaggagacagaccacttgccacgctgttgtaaaaacccaagtccctgtcatttgaacctggatccagcactggtgaactgagctgggcaggaagggagaacttgaaacagattcaggccagcccagccaggccaacagcacctccccgctgggaagagaagagggcccagcccagagccacctggatctatccctgcggcctccacacctgaacttgcctaactaactggcaggggagacaggagcctagcggagcccagcctgggagcccagagggtggcaagaacagtgggcgttgggagcctagctcctgccacatggagccccctctgccggtcgggcagccagcagagggggagtagccaagctgcttgtcctgggcctgcccctgtgtattcaccaccaataaatcagaccatgaaacctgaaaaaaaaaaaaa

SEQ ID NO: 46 - DNA, 1539 bp, Homo sapiens
ccagtctccgcgcctccacccagctcaggaacccgcgaaccctctcttgaccactatgagcctcccgtccagccgcgcggcccgtgtcccgggtccttcgggctccttgtgcgcgctgctcgcgctgctgctcctgctgacgccgccggggcccctcgccagcgctggtcctgtctctgctgtgctgacagagctgcgttgcacttgtttacgcgttacgctgagagtaaaccccaaaacgattggtaaactgcaggtgttccccgcaggcccgcagtgctccaaggtggaagtggtagcctccctgaagaacgggaagcaagtttgtctggacccggaagccccttttctaaagaaagtcatccagaaaattttggacagtggaaacaagaaaaactgagtaacaaaaaagaccatgcatcataaaattgcccagtcttcagcggagcagttttctggagatccctggacccagtaagaataagaaggaagggttggtttttttccattttctacatggattccctactttgaagagtgtgggggaaagcctacgcttctccctgaagtttacagctcagctaatgaagtactaatatagtatttccactatttactgttattttacctgataagttattgaaccctttggcaattgaccatattgtgagcaaagaatcactggttattagtctttcaatgaatattgaattgaagataactattgtatttctatcatacattccttaaagtcttaccgaaaaggctgtggatttcgtatggaaataatgttttattagtgtgctgttgagggaggtatcctgttgttcttactcactcttctcataaaataggaaatattttagttctgttttcttggggaatatgttactctttaccctaggatgctatttaagttgtactgtattagaacactgggtgtgtcataccgttatctgtgcagaatatatttccttattcagaatttctaaaaatttaagttctgtaagggctaatatattctcttcctatggttttagatgtttgatgtcttcttagtatggcataatgtcatgatttactcattaaactttgattttgtatgctattttttcactataggatgactataattctggtcactaaatatacactttagatagatgaagaagcccaaaaacagataaattcctgattgctaatttacatagaaatgtattctcttggttttttaaataaaagcaaaattaacaatgatctgtgctctgcaaagttttgaaaatatatttgaacaatttgaatataaattcatcatttagtcctcaaaatatatacagcattgctaagattttcagatatctattgtggatcttttaaaggttttgaccattttgttatgaggaattatacatgtatcacattcactatattaaaattgcacttttattttttcctgtgtgtcatgttggtttttggtacttgtattgtcatttggagaaacaataaaagatttctaaaccaaaaaaaaaaaaaaaaaaa

SEQ ID NO: 47 - DNA, 1564 bp, Homo sapiens
gaagcacatctggacagctgtgcggcctccttgcgggccgacgtcagccgagcacgtcccccacgtcctctccttctcgccacttattatttattcgttttcccaaagaagcgactagggacccaagtttaaaaattcctccccccactcaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgc

SEQ ID NO: 48 - DNA, 3310 bp, Homo sapiens; identical to SEQ ID NO: 23

SEQ ID NO: 49 - DNA, 1638 bp, Homo sapiens; identical to SEQ ID NO: 38

SEQ ID NO: 50 - DNA, 615 bp, Homo sapiens
gaaaatgatattaattttattgcatcattttactgactagaacgccagacttagagtggatataagtataaaaataaccaaattcttacaaataatactttgctgctacagtactgaataattagtggaggttgcaattataatacaactttaaataacattctcataatgggtttaacacaatcaaccaggggctaaggtttaaaggtttacaaagagaaatccaggacaacatgaaaactcccaaagttcatattccagctaaatgcttcatttaaccgtcaatccaccaacacaaacattaacaaaactcagagcaactcatgatgaaacagtcgttctctttttaggacaggccaaggttaatacagaaaggtaaatgattcggattagtttcccaggcagaactgattccatcccatccctggcctatcccatcctccctacccaagaaatctgtaatgaagtatgttaagtgcattttaaaaatctgaatatgcaaattcttcaaaatgtcctctttgaaaatgcccaggtgacagacccagtctcggacctgtcgctttttagacctgaatggtccccctttggtttcatagggttttctgtgagcag

SEQ ID NO: 51 - DNA, 4465 bp, Homo sapiens
caattgtcatacgacttgcagtgagcgtcaggagcacgtccaggaactcctcagcagcgcctccttcagctccacagccagacgccctcagacagcaaagcctacccccgcgccgcgccctgcccgccgctcggatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtcttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactatcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagatgaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatctcaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataacgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactattta

SEQ ID NO: 52 - DNA, 5514 bp, Homo sapiens; identical to SEQ ID NO: 5

SEQ ID NO: 53 - DNA, 3310 bp, Homo sapiens; identical to SEQ ID NO: 23

SEQ ID NO: 54 - DNA, 6784 bp, Homo sapiens
ggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 55 - DNA, 1518 bp, Homo sapiens
aaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgagtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgtgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctcca

SEQ ID NO: 56 - DNA, 2282 bp, Homo sapiens
ccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagctaaaaaaaaaaaaaaaaagg

SEQ ID NO: 57 - DNA, 2443 bp, Homo sapiens; identical to SEQ ID NO: 32

SEQ ID NO: 58 - DNA, 1959 bp, Homo sapiens
tctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaaaaaaaaaaaaaaaaaaaaa

SEQ ID NO: 59 - DNA, 5065 bp, Homo sapiens
gccttagaaaagttaacgagaaccagatgtggtggccactgccgaactttctcagagccggtgattggtccccagccgagggcctcagccaattagcttgctgggtgggcctggagtcccgccccgcccaggcgcccgcggagatccaggttcgaggctggcgcggcgcggagagtgggctggaggccggggcgggacgcgttgtgcagcgggtaagcgcacggccgagcgagcatggagggggaccgggtggccgggcggccggtgctgtcgtcgttaccagtgctactgctgctgcagttgctaatgttgcgggccgcggcgctgcacccagacgagctcttcccacacggggagtcgtggggggaccagctcctgcaggaaggcgacgacgaaagctcagccgtggtgaagctggcgaatcccctgcacttctacgaagcccgattcagcaacctctacgtgggcaccaacggcatcatctccactcaggacttccccagggaaacgcagtatgtggactatgatttccccaccgacttcccggccatcgccccttttctggcggacatcgacacgagccacggcagaggccgagtcctgtaccgagaggacacctcccccgcagtgctgggcctggccgcccgctatgtgcgcgctggcttcccgcgctctgcgcgctttacccccacccacgccttcctggccacctgggagcaggtaggcgcttacgaggaggtcaagcgcggggcgctgccctcgggagagctgaacactttccaggcagttttggcatctgatgggtctgatagctacgccctctttctttatcctgccaacggcctgcagttccttggaacccgccccaaagagtcttacaatgtccagcttcagcttccagctcgggtgggcttctgccgaggggaggctgatgatctgaagtcagaaggaccatatttcagcttgactagcactgaacagtctgtgaaaaatctctatcaactaagcaacctggggatccctggagtgtgggctttccatatcggcagcacttccccgttggacaatgtcaggccagctgcagttggagacctttccgctgcccactcttctgttcccctgggacgttccttcagccatgctacagccctggaaagtgactataatgaggacaatttggattactacgatgtgaatgaggaggaagctgaataccttccgggtgaaccagaggaggcattgaatggccacagcagcattgatgtttccttccaatccaaagtggatacaaagcctttagaggaatcttccaccttggatcctcacaccaaagaaggaacatctctgggagaggtagggggcccagatttaaaaggccaagttgagccctgggatgagagagagaccagaagcccagctccaccagaggtagacagagattcactggctccttcctgggaaaccccaccaccgtaccccgaaaacggaagcatccagccctacccagatggagggccagtgccttcggaaatggatgttcccccagctcatcctgaagaagaaattgttcttcgaagttaccctgcttcaggtcacactacacccttaagtcgagggacgtatgaggtgggactggaagacaacataggttccaacaccgaggtcttcacgtataatgctgccaacaaggaaacctgtgaacacaaccacagacaatgctcccggcatgccttctgcacggactatgccactggcttctgctgccactgccaatccaagttttatggaaatgggaagcactgtctgcctgagggggcacctcaccgagtgaatgggaaagtgagtggccacctccacgtgggccatacacccgtgcacttcactgatgtggacctgcatgcgtatatcgtgggcaatgatggcagagcctacacggccatcagccacatcccacagccagcagcccaggccctcctccccctcacaccaattggaggcctgtttggctggctctttgctttagaaaaacctggctctgagaacggcttcagcctcgcaggtgctgcctttacccatgacatggaagttacattctacccgggagaggagacggttcgtatcactcaaactgctgagggacttgacccagagaactacctgagcattaagaccaacattcaaggccaggtgccttacgtcccagcaaatttcacagcccacatctctccctacaaggagctgtaccactactccgactccactgtgacctctacaagttccagagactactctctgacttttggtgcaatcaaccaaacatggtcctaccgcatccaccagaacatcacttaccaggtgtgcaggcacgcccccagacacccgtccttccccaccacccagcagctgaacgtggaccgggtctttgccttgtataatgacgaagaaagagtgcttagatttgctgtgaccaatcaaattggcccggtcaaagaagattcagaccccactccggggaatccttgctatgatgggagccacatgtgtgacacaacagcacggtgccatccagggacaggtgtagattacacctgtgagtgcgcatctgggtaccagggagatggacggaactgtgtggatgaaaatgaatgtgcaactggctttcatcgctgtggccccaactctgtatgtatcaacttgcctggaagctacaggtgtgagtgccggagtggttatgagtttgcagatgaccggcatacttgcatcttgatcaccccacctgccaacccctgtgaggatggcagtcatacctgtgctcctgctgggcaggcccggtgtgttcaccatggaggcagcacgttcagctgtgcctgcctgcctggttatgccggcgatgggcaccagtgcactgatgtagatgaatgctcagaaaacagatgtcaccctgcagctacctgctacaatactcctggttccttctcctgccgttgtcaacccggatattatggggatggatttcagtgcatacctgactccacctcaagcctgacaccctgtgaacaacagcagcgccatgcccaggcccagtatgcctaccctggggcccggttccacatcccccaatgcgacgagcagggcaacttcctgcccctacagtgtcatggcagcactggtttctgctggtgcgtggaccctgatggtcatgaagttcctggtacccagactccacctggctccaccccgcctcactgtggaccatcaccagagcccacccagaggcccccgaccatctgtgagcgctggagggaaaacctgctggagcactacggtggcaccccccgggatgaccagtacgtgccccagtgcgatgacctgggccacttcatccccctgcagtgccacggaaagagcgacttctgctggtgtgtggacaaagatggcagagaggtgcagggcacccgctcccagccaggcaccacccctgcgtgtatacccaccgtcgctccacccatggtccggcccacgccccggccagatgtgacccctccatctgtgggcaccttcctgctctatactcagggccagcagattggctacttacccctcaatggcaccaggcttcagaaggatgcagctaagaccctgctgtctctgcatggctccataatcgtgggaattgattacgactgccgggagaggatggtgtactggacagatgttgctggacggacaatcagccgtgctggtctggaactgggagcagagcctgagacgatcgtgaattcaggtctgataagccctgaaggacttgccatagaccacatccgcagaacaatgtactggacggacagtgtcctggataagatagagagcgccctgctggatggctctgagcgcaaggtcctcttctacacagatctggtgaatccccgtgccatcgctgtggatccaatccgaggcaacttgtactggacagactggaatagagaagctcctaaaattgaaacgtcatctttagatggagaaaacagaagaattctgatcaatacagacattggattgcccaatggcttaacctttgaccctttctctaaactgctctgctgggcagatgcaggaaccaaaaaactggagtgtacactacctgatggaactggacggcgtgtcattcaaaacaacctcaagtaccccttcagcatcgtaagctatgcagatcacttctaccacacagactggaggagggatggtgttgtatcagtaaataaacatagtggccagtttactgatgagtatctcccagaacaacgatctcacctctacgggataactgcagtctacccctactgcccaacaggaagaaagtaagtacagtaatgtaaaggaagacttggagtttacaatcagaacctggaccctaaagaacagtgactgcaaaggcaaagaaagtaaaaaaggaattggccattagacgttcctgagcatccaagatgaacattttgtagtgcaaaaagacttttgtgaaaagctgatacctcaatctttactactgtatttttaaaaatgaaggttgttattgcaagtttaaaaaggtaacagaattttaactgttgcttattaaagcaacttcttgtaaacatttatcattaatatttaaaagatcaaattcattcaactaagaattagagtttaagactctaaacctgatttttgccatggattccttctggccaagaaattaaagcacatgtgatcaatataacaatataatcctaaaccttgacagttggagaagccaatgcagaactgatgggaaaggaccaattatttatagtttcccaacaaaagttctaagattttttacctctgcatcagtgcatttctatttatatcaaaaggtgctaaaatgattcaatttgcattttctgatcctgtagtgcctctatagaagtacccacagaaagtaaagtatcacatttataaataccaaagatgtaacaattttaaaattttctagattactccaataaagtgttttaagttttcctatgaaaaaaaaaaaaaaaaaaaa

SEQ ID NO: 60 - DNA, 2184 bp, Homo sapiens
ttatatgttgatttttctttctctctgatttcccagtttcagattgaatgtctgtcttgcaggcagttatttcaaaatccatagtcttttgcctttctcactggcaaaatttgaagcaatctctctcttcaatgtatgatttcaaaactaaaattttaaaagagaagaataaatatcttatccaagacttcattgcatatctagagcaagagtggcaaactttttctgtaaaggactatatagaaaatattttccacaaggtctatgttgcaacttctcaactttgccattctgctaatgcaatcttagtaaataaaagaatgaacataactgttttcctatataacttcccttacaaaaacagccagtaggccacctttgcaggtcatattttgctgacccctggtctggatgttttttaatgctagctctccatggtgtcatctttcgttttcattcatttttcaaaggtgagaatttacagtcattacatttcccactgtatcagaagtagctgtattttctacagatgtagccctgggaatggcacagtggaacaatatttaactaactcagcagacttcttgcaaatgaaaagaaaactcaaaaggtgccattaaaaagcaataccattttcaggcaacattattgcaacaacctttgtgagagaggacactagcttttcaggatatttgaaaaataatataactaacatgctattttatcttaaacagctgtgttcctgtaaaagtgttttggattagaaggtatttttaccttcatactggagtatgaactccccctgctgttcattagagtatttgcaaagattacaaaagacatcaggttaggatgtcattgtccccaaaatgaaaatatttgtatgtatttcaataagaactaaatgcagtaagcgctaattcctcattcaatattcactatattaggaaatgtaaatcatttcaaagagaacaggtagtcaggaagatgaaaattttactttaaagcaaggatttaaacaaagaaaaccataaaaacaaagtccattttatctgttttattaaagaggaagaaaaaataatattgttactttaaaactgtgattgtcaatatatataatcaggggtcttccagataatcctaaagttgatctctttgaataaaataaactccatttgtccaaaatagttaagaaagactctattgtggttacttgaaaaattcagctaaccctcttatgaaatgtgtgcaacacctattaattttgaaatgtgggatagaatacctactaaagctatatttaaggtattgtaaaatgtcattaattcagaaaggattagtatcatcctacctataagaattaaattagcaaatcaaaattatagaatgttatgaaaaatacattttattcataaattaattagattttacagcatatatgcatgcatatatatatatacacacacacacacacacacccatatatatgagagagaggaaattaggttcaacatgacctaatattagagaacatattggaaggtcactgtttgttaggataaataaatactggataacctcgttagaaaggtggaaagaggagaacgtagcaatctggctattttggacaaagggaaggttattatattcatgtttataacatgaaaatggccttatttttgtttctgacatgagacaataatgagttaaatattttattggaatttcatcaaaaccttatttttactgctccttctaaaaatttgggaggggaatatagtagtaacttctctattgacacttttacctcaccgagggggtaaaagatgtagaactgctgttccctagaatgaaggtctgttgtttggtttttaaaaaaagaagagcagaaaaagtttgacacagtattatatgattttgctggactatttcactagaaaccacgtagaataggactaactgatctcttttgaaaggggctgatttgcttattcatcaataactaatccaatatgtggacagtaatcttaatttcaaagccttttttgaggatactacggtgtagcttaagtgaatttaaaaagagtgcataaaagcttgtttttaattacttataacaaagcacaaattacttctaacaaggcaaatatttattgacatataagacattctgctaggcattgt

SEQ ID NO: 61 - DNA, 1124 bp, Homo sapiens
gccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaaaaaaaaaaaaaaaa

SEQ ID NO: 62 - DNA, 901 bp, Homo sapiens
gggatctcggactccctggaccctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtacttggataggctggctaactcgtaggaagagagcactgtatggtatccttttgctttattcaccagcattttgggggaacatttcttttacattttaaataaaacttcagcttg

SEQ ID NO: 63 - DNA, 2102 bp, Homo sapiens
acacccagctgcctgagaccctccttcaacctccctagaggacagccccactctgcctcctgctcccccagggcagcaccatgtggcccctgtggctctgctgggcactctgggtgctgcccctggctggccccggggcggccctgaccgaggagcagctcctgggcagcctgctgcggcagctgcagctcagcgaggtgcccgtactggacagggccgacatggagaagctggtcatccccgcccacgtgagggcccagtatgtagtcctgctgcggcgcagccacggggaccgctcccgcggaaagaggttcagccagagcttccgagaggtggccggcaggttcctggcgtcggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccaggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggacctcagggactatggagctcagggcgactgtgaccctgaagcaccaatgaccgagggcacccgctgctgccgccaggagatgtacattgacctgcaggggatgaagtgggccaagaactgggtgctggagcccccgggcttcctggcttacgagtgtgtgggcacctgccagcagcccccggaggccctggccttcaattggccatttctggggccgcgacagtgtatcgcctcggagactgcctcgctgcccatgatcgtcagcatcaaggagggaggcaggaccaggccccaggtggtcagcctgcccaacatgagggtgcagaagtgcagctgtgcctcggatggggcgctcgtgccaaggaggctccagccataggcgcctggtgtatccattgagccctctaactgaacgtgtgcatagaggtggtcttaatgtaggtcttaactttatacttagcaagttactccatcccaatttagtgctcctgtgtgaccttcgccctgtgtccttccatttcctgtctttcccgtccatcacccatcctaagcacttacgtgagtaaataatgcagctcagatgctgagctctagtaggaaatgctggcatgctgattacaagatacagctgagcaatgcacacattttcagctgggagtttctgttctctggcaaattcttcactgagtctggaacaataataccctatgattagaactggggaaacagaactgaattgctgtgttatatgaggaattaaaaccttcaaatctctatttcccccaaatactgacccattctggacttttgtaaacatacctaggcccctgttcccctgagagggtgctaagaggaaggatgaagggcttcaggctgggggcagtggacagggaattgggatacctggattctggttctgacagggccacaagctaggatctctaacaaacgcagaaggctttggctcgtcatttcctcttaaaaaggaggagctgggcttcagctctaagaacttcattgccctggggatcagacagcccctacctacccctgcccactcctctggagactgagccttgcccgtgcatatttaggtcatttcccacactgtcttagagaacttgtcaccagaaaccacatgtatttgcatgttttttgttaatttagctaaagcaattgaatgtagatactcagaagaaataaaaaatgatgtttcaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 64 - DNA, 2828 bp, Homo sapiens
agaccaccttgcggccgaccccgctcccccgcctcctcgggagagataaatgctgactccgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtgcaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggatttttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccattttttgcaatgatgtctggatgttattttaaacagtgtgtctgtgtgttcccaaatccagctggccccaccagctcagattccattttttttgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaataaaacaaatgattgtgtacaaaaaaaaaaaaaaaaaa

SEQ ID NO: 65 - DNA, 3142 bp, Homo sapiens
gtggccgctgccgcctctgcctgggtcccttcggccgtacctctgcgtgggggctgcctccccggctcccggtgcagacaccatgtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacacgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattgtggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggcgctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgtcaaaaaaaaaaaaaaaa

SEQ ID NO: 66 - DNA, 1855 bp, Homo sapiens
ctggccggcactcggcggccgcggcgcgatggaggcgccggccgagctactggccgcgctgcctgcgctggccaccgcgctggcccttctgctcgcctggctactggtgcggcgtggggcggccgcgagcccggagcctgcccgcgcgcccccggaacccgcgcccccggccgaggccaccggggccccggcgccgtcccgcccctgcgcccccgagccggcggcctcgcccgcggggccggaggagcctggagagcccgcggggctgggggagctcggggagcctgcgggaccgggggagcccgaagggccaggggatcccgcggcggcgccagcggaggcggaggagcaggcggtggaggcgaggcaggaagaggagcaggacttggatggtgagaaggggccatcatcggaagggcctgaggaggaggacggagaaggcttctccttcaaatacagccccgggaagctgaggggaaaccagtacaagaagatgatgaccaaagaggagctggaggaggagcagagaactgaagaataacgaagttatccttagcgtcctcctaaaggcttttccttttggcatcttaaaagcttgagagataaaacggaaaccccagagaggagtctgggcaggctcccagggtgcatgctgcctccataaatctgctgagctctagaccctcaatcaggacttgtcccttggctagcaggatcctgggaacacctttggccctgccctgtgtagagatgttcatgtctgttcctgtgggtcactttgttaagctgaagagttttaagaggtagagctcagaccctggactgggatttttcttaccactcaaacttgctatccacacaccctgcacaccttagataaaaagaacattttaaaagcagagttcactttcactccagtctcccctcttttgccctcactgaagccaaaccacagaagactttgaggaatgagagacaaatgaggtagagctcacctgtgctcaccagctccgtcagggtggtcagccgacccctttccctgggaaccccacttctctctgtggctggcttggttgtcgggggtgagatgccatattgattacagggcagcaaagaaccagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccaggggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgacacaataggtcgttgactccctcctagtagagctatctaggtttgtctggaaagtttccgaccctggcttataggcaccacacctcatgtactcctcatggcttggatctctgtattcagcctttgttcagtccaataaactttgagtagatgatctcaaaaaaaaaaaaaaaaaa

SEQ ID NO: 67 - DNA, 1440 bp, Homo sapiens; identical to SEQ ID NO: 42

SEQ ID NO: 68 - DNA, 811 bp, Homo sapiens
tgtagtttagcttcgttgaattttttttgacactggaaatgttcaactgtagttttattaaggaagccaggcatgcaacagattttgtgcatgaaatgagacttcctttcagtgtaagagcttaaagcaagctcagtcatacatgacaaagtgtaattaacactgatgtttgtgttaaatttgcagcagagcttgagaaaagtacattgttctggaatttcatcattaacattttataatcttacactcacttgttgtctttttgtgggttcaagagccctctgacttgtgaagaatttgctgccctcttaagagcttgctgacttgttttcttgtgaaattttttgcacatctgaatatcgtggaagaaacaataaaactacaccatgaggaaaactaaaggtctttatttaaaatctggcattgtattaacatgtaattttatactatgtggtattttatacatttcctcagtagtgatatttggtaaagcagttcatacagcttttttctaagttccatgaatcttacccagtgtttaccgaagtatttaagcagcatctgaatatttccacccagcaatgttaatttatctaggaaagttcagaatttcatcttcatgttgaatttcccttttaacttccgttcatagacatatatgtgacttccaattcgaccctctggcaagtgagtgtggaagaaaacagcagttcttttataattgcttgaaattaggaaagcgcttatttcctagaagcaaataaatgtttaagtaaataaaggctacattttgccgaaaaaaaaaaaaaaa

SEQ ID NO: 69 - DNA, 577 bp, Homo sapiens
aacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatatagttaaattcactagatcttga

SEQ ID NO: 70 - DNA, 2463 bp, Homo sapiens
ctctttccctccctcctctcctctccctctcctctcctgctatagagggctccgacagcagttcccagccagcgtgttcagcctgcctgcctgcctgcctctgtgtgtgtgtgagcgtgtgtgcgtgcgtctactttgtactgggaagaacacagcccatgtgctctgcatggacgttactgatactctgtttagcttgattttcgaaaagcaggcaagatgtccagcacaccacatgaccccttctattcttctcctttcggcccattttataggaggcatacaccatacatggtacagccagagtaccgaatctatgagatgaacaagagactgcagtctcgcacagaggatagtgacaacctctggtgggacgcctttgccactgaattttttgaagatgacgccacattaaccctttcattttgtttggaagatggaccaaagcgatacactatcggcaggaccctcatcccccgttactttagcactgtgtttgaaggaggggtgaccgacctgtattacattctcaaacactcgaaagagtcataccacaactcatccatcacggtggactgcgaccagtgtaccatggtcacccagcacgggaagcccatgtttaccaaggtatgtacagaaggcagactgatcttggagttcacctttgatgatctcatgagaatcaaaacatggcactttaccattagacaataccgagagttagtcccgagaagcatcctagccatgcatgcacaagatcctcaggtcctggatcagctgtccaaaaacatcaccaggatggggctaacaaacttcaccctcaactacctcaggttgtgtgtaatattggagccaatgcaggaactgatgtcgagacataaaacttacaacctcagtccccgagactgcctgaagacctgcttgtttcagaagtggcagaggatggtggctccgccagcagaacccacaaggcaaccaacaaccaaacggagaaaaaggaaaaattccaccagcagcacttccaacagcagcgctgggaacaatgcaaacagcactggcagcaagaagaagaccacagctgcaaacctgagtctgtccagtcaggtacctgatgtgatggtggtaggagagccaactctgatgggaggtgagtttggggacgaggacgaaaggctaatcactagattagaaaacacgcaatatgatgcggccaacggcatggacgacgaggaggacttcaacaattcacccgcgctggggaacaacagcccgtggaacagtaaacctcccgccactcaagagaccaaatcagaaaaccccccaccccaggcttcccaataagatgatcggcaccagaatccactgtcaataggcccgtgggtgatcattacaattgcaaatctttacttacaggagaggaaacagaagagataaaaacttttccatgcaaatatctatttctaaaccacaatgatctgattttctttcttctttctttttttctaattgagaggattattcccagtaagcttccatgaccctttcttggaggccttcacaggtaatacagatactggcactgattgtaattaaaatgagagaaaactctagcgcatcttctggcacggttttaacaacgtgtttgtgttgaatttcctttttatgcatcaaacgaaggccatattgtccataaatgctcagtgctcaggatctcattaatatgccgaacctaactacagatgactttttaatattgtaaaatattttctgctttttgacttgcatctgagagtttcttgtttcagtaaaaaaagaaaagacaaaaaaatcagctttggaaagtaatttaaatgtaccttattttttttttctttatgttttctttcattgggcaacagctaagagggcccagcaaggtaatttatggttgagctgatgtcaattggttcttgtcttgagtcgactcaatttagcccaagtgctgaaacaagaaatgtcatttttttcatcaaagacaccagggcagatttttaagtaaagaaagacaattggacccttaagaatttatgcatttgtaaagttgctgttgatccaaatattttcaagccatgtaatccattggttttgtgggcagtttaataaacctgaacctttgtgtgttttctaattgtacctgagttgaccatcctttctttttatagtatatttcttgtatgatattttgtaaagctctcacctggttcttttatggggacttttcgtttttgggcaactccagtgtatttatgtgaaactttataagagaattaatttttccatttgcatattaatatgttcctccacacatgtaaaggcacagtggctccgtgtgttaaaaaacagctgtattttatgtatgctttactgataagtgtgccaataataaactgtgttaatgaccaaaaaaaaaaaaaaaaaaaaaaa

SEQ ID NO: 71 - DNA, 1893 bp, Homo sapiens
attagacagcacactgctgactgttttcagttgtttctgtaacagcagaaagtgcactcactaggagtagtcagaattcaaaatgctcaagagaaagccatccaatgtttcagagaaggagaaacatcaaaaaccaaagcgaagcagcagttttgggaatttcgatcgttttcggaataattctttatcaaaaccagatgattcaactgaggcacatgaaggagatcccacaaatggaagtggagaacaaagtaaaacttcaaataatggaggcggtttgggtaaaaaaatgagagctatttcatggacaatgaagaaaaaagtgggtaaaaagtacatcaaagccctttctgaggaaaaggatgaggaagatggagagaatgcccacccatatagaaacagtgaccctgtgattgggacccacacagagaaggtgtccctcaaagccagtgactccatggatagtctctacagtggacagagctcatcaagtggcataacaagctgttcagatggtacaagtaaccgggacagctttcgactggatgacgatggcccctattcaggaccattctgtggccgtgccagagtgcatacggatttcacgccaagtccctatgacactgactccctcaaaatcaagaaaggagacatcatagacattatttgcaaaacaccaatggggatgtggacaggaatgttgaacaataaagtgggaaacttcaaattcatttatgtggatgtcatctcagaagaggaagcagcccccaagaaaataaaggcaaaccgaaggagtaacagcaaaaaatccaagactctgcaggagttcctagagaggattcatctgcaggaatacacctcaacacttttgctcaatggttatgagactctagaagatttaaaagatataaaagagagtcacctcattgaattaaatattgaaaacccagatgacagaagaaggttactatcagctgctgaaaacttccttgaagaagaaattattcaagagcaagaaaatgaacctgagcccctatccttgagctcagacatctccttaaataagtcacagttagatgactgcccaagggactctggttgctatatctcatcaggaaattcagataatggcaaagaggatctggagtctgaaaatctgtctgacatggtacataagattattatcacagagccaagtgactgaacacgcattcccaactatatatctacagatgcattccattttaactcttcttgagctaaaacgtcaaataggagaggaagataagataaatatttgtaaataaaacctaaagtttaaatgttttaatctgaataattgtacataaaattttgtatctctaacattccaaattactgtcaataaaatatatatttattattttaaatgctatgtgttaatatttcacttgcttgtattagaaaggcaaaatgtaagactttggtatgtgtgacatatgctttatttggctttattttacaagtacagtatctgcaaaaaacaaagtaaccttttttcatacctgccagttttgaatttatatatgttattgaacaaatagtaatagaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaataataaaaagaactatttgcatattgcaaaaaa

SEQ ID NO: 72 - DNA, 1730 bp, Homo sapiens
gtctctcctgtctgaaggccagagcaggctgctaggcctggggccaccactgcccctgggtgctacacccagtgtgatgggtcactgggaacttcctgaagtggtgtcacctgaactgggcccccaaggatggggtgcgggcagtaccgcaggaagaggagcagcccctgtgaagattgagagctgccagaggctctgtgattggctgcggcacgatgacccgcgcacggattggctgcttcgggccggggggccgggcccgggggacagaatccgcccccgaaccttcaaagagggtaccccccggcaggagctggcagacccaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctcaaaaaaaaaaaaaaaaaaaaaaaaaaaaaaa

SEQ ID NO: 73 - DNA, 2704 bp, Homo sapiens
gggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggtt

SEQ ID NO: 74 - DNA, 1206 bp, Homo sapiens
ggaaggggacgcgaaccgtcctggtcccatccgagccgccgtagcgcgagtgccgcgggagttcggcagcccaggtcgccaaggcaacgggctccgctgcgggttgcgggctgcgggcgctaggctgccccggggaggcgctgcggaccggcggcccaggcacggagaggcggcgagaccgcagaattcccgtactgattagtcaacagtggaaaatctgaagagatgcaagcaggaaaaagaaattaaaccaggcctgaggagcgatgcgacaggcatgatggaggtcgagtcctcctactcggacttcatctcctgtgaccggacaggccgtcggaatgcggtccctgacatccagggagactcagaggctgtgagcgtgaggaagctggctggagacatgggcgagctggcactcgagggggcagaaggacaggtggagggaagcgccccagacaaggaagctggcaaccagccccagagcagcgatgggaccacctcgtcttgaatctgaccttgtccaagaaggctggacgagagaccttctgtcccctcccagagggggaaccctggcactggcccagcagcctcttctctgagctccatgtcccagataaaccaggccagactgagaaggctccccagaggcctctgtggcctccactccgggaaagccctctgcccacacccacaggcttcacattcccaccaccttcgcaccgtgcccaggtacactttcaagacactgtaaccacaagatgttatttattgagctggcgccgggacttgggcggggcctgccctacagtgagcagcccacacaggaacgctcctctcgcgagcggcccgggcagggaccctgtcccaacaccaacacctcctctccagcccaatcttctgggtccagacctgcttgtcccttttttagaaaacacttttaaactttttaaaaattttaaaccttttttcagcagatatggagagagctgacaatcaattcacattttttaagccattttagctaaactgtcattgtgcatctctgaggttccctcatggagctccacagatccatttttagggaagggattttggctcaaaacgatctgaccacctctgccctgtccaccaggataagtgacacctaggacccaggaaataaatgccgatgatttgtgtgaaaaaaaaaaaaaaaaaaaaaaaaaa

SEQ ID NO: 75 - DNA, 6276 bp, Homo sapiens
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagccctgaagccgagcccgaggctaagtgggactgaccggggcccagagtggacgaaccgccagcatggggagagaccagcgcgcggtggccggccctgccctacggcggtggctgctgctggggacagtgaccgtggggttcctcgcccagagcgtcttggcgggtgtgaagaagtttgatgtgccgtgtggaggaagagattgcagtgggggctgccagtgctaccctgagaaaggtggacgtggtcagcctgggccagtgggcccccaggggtacaatgggccaccaggattacaaggattccccgggctgcagggacgtaaaggagacaagggtgaaaggggagcccccggagtaacaggacccaagggcgacgtgggagcaagaggcgtttctggattccctggtgccgatggaattcctggacacccggggcaaggtgggcccaggggaaggccgggctacgatggctgcaacggaacccagggagactcaggtccacaggggccccccggctctgaggggttcaccgggcctcccgggccccaaggaccaaaagggcagaaaggtgagccttatgcactgcctaaagaggagcgcgacagatatcggggtgaacctggagagcctggattggtcggtttccagggacctcccggccgccctgggcatgtgggacagatgggtccagttggagctccagggagaccaggaccacctggaccccctggaccaaaaggacagcaaggcaacagaggacttggtttctacggagttaagggtgaaaagggtgacgtagggcagccgggacccaacgggattccatcagacaccctccaccccatcatcgcgcccacaggagtcaccttccacccagatcagtacaagggtgaaaaaggcagtgagggggaaccaggaataagaggcatttccttgaagggagaagaaggaatcatgggctttcctggacttaggggttaccctggcttgagtggtgaaaaaggatcaccaggacagaagggaagccgaggcctggatggctatcaagggcctgatggaccccggggacctaagggagaagccggagacccagggccccctggactacctgcctactcccctcacccttccctagcaaaaggtgccagaggtgacccaggattcccaggggcccaaggggagccaggaagccagggtgagccaggagacccgggcctcccaggtccccctggcctctccattggagatggagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggcttcctgtttgggctgaaaggagcaaaaggaagagcaggcttccctgggcttcccggctcccctggagcccccggaccaaaggggtggaaaggtgacgctggggaatgcagatgtacagaaggcgacgaagctatcaaaggtcttccaggactgccaggacccaagggcttcgcaggcatcaacggggagccggggaggaaaggggacaaaggagaccccggccaacacggcctccctgggttcccagggctcaagggagtgcctggcaacattggtgctcccggacccaaaggagcaaaaggagattccagaacaatcacaaccaaaggtgagcggggacagcccggcgtcccaggtgtgcccgggatgaaaggtgacgatggcagcccaggccgcgatgggctcgatggattccccggcctcccaggccctcccggtgatggcatcaagggccctccaggggacccaggttatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaatagattgtgacacagatgtgaaaagggccgttggaggtgacagacaggaggccatccagccaggttgcataggagggcccaagggattgccaggcctgccaggacccccaggccccacaggtgccaaaggcctccgaggaatcccaggcttcgcaggagctgatggaggaccagggcccaggggcttgccaggagacgcaggtcgtgaagggttcccaggacccccagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccggggtgacaaaggtgccccagggagagcaggcctgtatggcgagattggcgcgactggtgatttcggtgacatcggggacactataaatttaccaggaagaccaggcctgaagggggagcggggcaccactggaataccaggtctgaagggattctttggagagaagggaacagaaggtgacatcggcttccctgggataacaggcgtgactggagtccaaggccctcctggacttaaaggacaaacaggctttccagggctgactgggcctccagggtcgcagggagagctggggcggattggactgcctggtggcaaaggagatgatggctggccgggagctccgggcttaccaggttttccgggactccgtgggatccgcggcttacacggcttgccaggcaccaagggctttccaggatccccaggttctgacatccacggagacccaggcttcccaggccctcctggggaaagaggtgacccaggagaggccaacacccttccaggccctgtgggagtcccaggacagaaaggagaccaaggagctccaggggaacgaggcccacctgggagcccaggacttcaggggttcccaggcatcacacccccttccaacatctctggggcacctggtgacaaaggggcgccagggatatttggcctgaaaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaagggcccaggggtgaacaaggcttcatggggaacactggacccaccggggcggtgggcgacagaggccccaagggacccaagggagacccaggattccctggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggttttcgtggggctccagggaaagctgggccccaaggaagaggtggtgtgtctgctgttcccggcttccggggagatgaaggacccataggccaccaggggccgattggccaagaaggtgcaccaggccgtccagggagcccgggcctgccgggtatgccaggccgcagcgtcagcatcggctacctcctggtgaagcacagccagacggaccaggagcccatgtgcccggtgggcatgaacaaactctggagtggatacagcctgctgtacttcgagggccaggagaaggcgcacaaccaggacctggggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatgcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggctttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcaggggctcaggcacccgtccccacacgagggccccgtgggtgggcctggccctgctttctacgccaatgttatgccagctccatgttctcccaaataccgttgatgtgaattattttaaaggcaaaaccgtgctctttattttagaaaacactgataatcacactgcggtaggtcattcttttgccacatccctatagaccactgggtttggcaaaactcaggcagaagtggagacccttctagacatcactgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatatttttaaaaaaaaaaaaaaaa

SEQ ID NO: 76 - DNA, 428 bp, Homo sapiens
atgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaaaaaaaaaaaaa

SEQ ID NO: 77 - DNA, 2155 bp, Homo sapiens
ccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaacactgtgtacataggtttatctcctattggaatattttctttatataggcgttttttttttttcttttttttggagacagagtcttgctctgttgcccaggctggagtgcagtggcgtgaccggagctcactgcaacctccacttcccgggttcaagtgattgtcccacctcagcctcctgaatagctgggattacaggtgcatgctaccacgcctggctactttttgtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaagaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaaccccagcactttgggaggccaaggcaggagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaaaaaaaaaaaaaa

SEQ ID NO: 78 - DNA, 1270 bp, Homo sapiens
attttctaaaagggacagagagcaccctgctacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcggagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctattttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaaggttaaaaaaaaaaaaaaaaaa

SEQ ID NO: 79 - DNA, 2112 bp, Homo sapiens
cggctttcaaagccaatttgaataaacaactcttccctctcaaatgggcaagagtaactcttcagcaccatggagaggtccgggcagcgtgttacaacgtgggactgtgaccagggcaagcactctgacagtgattaccgagaggatgggatggatctaggcagtgacgccggcagcagcagcagcagcagccgcgccagttcacagtccaactccaccaaagtgaccccttgctccgagtgcaaatcttcatcgtcgccggggggcagcctggacttggtgtctgccctggaggactatgaggagcccttcccggtctaccagaagaaggtgattgatgagtgggcgccggaggaggacggggaggaggaggaagaggaggacgagcgcgaccagcgagggtaccgggatgaccgctctccggcccgggaaccgggggacgtaagcgccaggacccgcagcggcggcggcgggggcaggagcgccaccaccgccatgccgcccccggtgcccaacggcaacctccaccagcacgacccccaggacctcaggcacaatggcaacgtggtggtggctggccggccgagctgttcccggggcccccgccgggcgatccaaaagccccagccggctgggggccggcgcagtggccgcggcccggcggctggggggctctgccttcagcccccagacggcgggacgtgcgtccccgaagagcccccggtgccacctatggattgggaggcgctggagaagcatctggccgggctgcagttccgggagcaggaggtacggaaccagggccaggcgaggaccaactccacctccgcacagaaaaatgagagagagtctatcagacagaagttggcacttggaagcttctttgatgatggcccaggaatttataccagctgtagcaaaagtgggaagccaagcctttcctcccgactgcagagtgggatgaacttgcagatatgctttgtcaacgacagtggcagtgataaggacagtgatgctgatgacagtaagactgaaaccagcttggacacccccttgtctcccatgagcaaacagagttcttcctattctgatagagacactactgaagaggagtctgaatccttggatgacatggacttccttacaaggcaaaagaaattgcaagctgaagccaaaatggcccttgccatggccaaaccaatggccaaaatgcaagtagaagtggagaaacagaacaggaaaaagtctcccgtcgctgatcttctgccacacatgcctcatataagtgaatgcttgatgaaaagaagtttaaaacccaccgacctgagagacatgactattgggcagctacaagtgatagtcaatgatctccattcccagatagaaagcttgaatgaagagttggtccagctgcttctcatccgagatgagctgcacacagagcaggatgccatgctggtggacattgaagacttgaccagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaacccg

SEQ ID NO: 80 - DNA, 1270 bp, Homo sapiens; identical to SEQ ID NO: 78

SEQ ID NO: 81 - DNA, 3981 bp, Homo sapiens
cgacaggggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttcaaaaaaaaaaaa

SEQ ID NO: 82 - DNA, 6784 bp, Homo sapiens; identical to SEQ ID NO: 54

SEQ ID NO: 83 - DNA, 3537 bp, Homo sapiens
ggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaacaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactggaaaaaaaa

SEQ ID NO: 84 - DNA, 2308 bp, Homo sapiens
ttagagacgagttttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagccgggctggctcccttctacgcctccaacttcagcctctggtcggccgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagcaaagacctcaaatttggaattgaccgcattttatctgcagaatttgacccaaaagtcaaagaaggcaacacgctgagagatctcacttccctgctaaccggtgggcggcccgccggggtgcacctctcaggcctgcagccctcggccggccagttcttcgcatctctagatcccattaacgaggcttctgcaatcctgagtcccttaaactcgaacccaagaaattcagttcagcatcagttccaagacacgtttccaggtccctatgctgtgctcacgaaggacaccatgccgcagacgtacaaaaggaagcgttcatggtcgcgcgctgtgttctccaacctgcagaggaaaggcctggagaaaaggtttgagattcagaagtacgtgaccaagccggaccgaaagcagctggcggcgatgctgggcctcacggacgcacaggtgaaggtgtggttccagaaccggcggatgaagtggcggcactccaaggaggcccaggcccaaaaggacaaggacaaggaggctggcgagaagccatcaggtggagccccggctgcggatggcgagcaggacgagaggagccccagccgttctgaaggcgaggctgagagcgagagcagcgactccgagtccctggacatggcccccagcgacacggagcggactgaggggagtgagcgttctctgcaccaaacaacagttattaaggccccggtcactggcgccctcattaccgccagcagtgctgggagtggtgggagcagcggcggcggcggcaatagtttcagcttcagcagcgccagcagtcttagtagcagcagcaccagtgcgggttgcgccagcagccttggcggcggcggcgcctcggagcttctccctgcaacacagcccacagccagcagcgctcccaaaagccccgagccagcccaaggcgcgcttggctgcttatagactgtactagggcggaggggatccgggccttgcgtgcagcctcccaaccatgggctgggttttgtgcttactgtatgttggcgacttggtagggcaggagacgcagcgtggagcctacctcccgacattcacgcttcgccccacgctgctccgactggctgcagcggacactgcccaaagcagaggggagtctcagtgtcctgctagccagccgaacacttctctccggaagcaggctggttcgactgtgaggtgtttgactaaactgtttctctgactcgccccagaggtcgtggctcaaaggcacttaggacgccttaaatttgtaaataaaatgtttactacggttaaaaaaaaaaaaaaaaaaaaaaaaaaaaaaaaaaaaaaaaaaaaaaaaaa

SEQ ID NO: 85 - DNA, 4468 bp, Homo sapiens
gatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagtaaaaaaaaaaaaaaaaaa

SEQ ID NO: 86 - DNA, 3226 bp, Homo sapiens
gccgccccgcgagcctccagcccctcgcctgttgccgcgcgagtcccgggcccggagcgctaggagcgcgcggaaggagccatggctctggacgggataaggatgccagatggctgctacgcggacgggacgtgggaactgagtgtccatgtgacggacctgaaccgcgatgtcaccctgagagtgaccggcgaggtgcacattggaggcgtgatgcttaagctggtggagaaactcgatgtaaaaaaagattggtctgaccatgctctctggtgggaaaagaagagaacttggcttctgaagacacattggaccttagataagtatggtattcaggcagatgctaagcttcagttcacccctcagcacaaactgctccgcctgcagcttcccaacatgaagtatgtgaaggtgaaagtgaatttctctgatagagtcttcaaagctgtttctgacatctgtaagacttttaatatcagacaccccgaagaactttctctcttaaagaaacccagagatccaacaaagaaaaaaaagaagaagctagatgaccagtctgaagatgaggcacttgaattagaggggcctcttatcactcctggatcaggaagtatatattcaagcccaggactgtatagtaaaacaatgacccccacttatgatgctcatgatggaagccccttgtcaccaacttctgcttggtttggtgacagtgctttgtcagaaggcaatcctggtatacttgctgtcagtcaaccaatcacgtcaccagaaatcttggcaaaaatgttcaagcctcaagctcttcttgataaagcaaaaatcaaccaaggatggcttgattcctcaagatctctcatggaacaagatgtgaaggaaaatgaggccttgctgctccgattcaagtattacagcttttttgatttgaatccaaagtatgatgcaatcagaatcaatcagctttatgagcaggccaaatgggccattctcctggaagagattgaatgcacagaagaagaaatgatgatgtttgcagccctgcagtatcatatcaataagctgtcaatcatgacatcagagaatcatttgaacaacagtgacaaagaagttgatgaagttgatgctgccctttcagacctggagattactctggaagggggtaaaacgtcaacaattttgggtgacattacttccattcctgaacttgctgactacattaaagttttcaagccaaaaaagctgactctgaaaggttacaaacaatattggtgcaccttcaaagacacatccatttcttgttataagagcaaagaagaatccagtggcacaccagctcatcagatgaacctcaggggatgtgaagttaccccagatgtaaacatttcaggccaaaaatttaacattaaactcctgattccagttgcagaaggcatgaatgaaatctggcttcgttgtgacaatgaaaaacagtatgcacactggatggcagcctgcagattagcctccaaaggcaagaccatggcggacagttcttacaacttagaagttcagaatattctttcctttctgaagatgcagcatttaaacccagatcctcagttaataccagagcagatcacgactgatataactcctgaatgtttggtgtctccccgctatctaaaaaagtataagaacaagcagataacagcgagaatcttggaggcccatcagaatgtagctcagatgagtctaattgaagccaagatgagatttattcaagcttggcagtcactacctgaatttggcatcactcacttcattgcaaggttccaagggggcaaaaaagaagaacttattggaattgcatacaacagactgattcggatggatgccagcactggagatgcaattaaaacatggcgtttcagcaacatgaaacagtggaatgtcaactgggaaatcaaaatggtcaccgtagagtttgcagatgaagtacgattgtccttcatttgtactgaagtagattgcaaagtggttcatgaattcattggtggctacatatttctctcaacacgtgcaaaagaccaaaacgagagtttagatgaagagatgttctacaaacttaccagtggttgggtgtgaatagaaatactgtttaatgaaactccacggccataacaatatttaactttaaaagctgtttgttatatgctgcttaataaagtaagcttgaaatttatcattttatcatgaaaacttctttgccttaccagaccagttaatatgtgcactaaacaagcacgactattaatctatcatgttatgatataataaacttgaatttggcacacattccttagggccatgaattgaaaactgaaatagtgggcaaatcaggaacaaaccatcactgatttactgatttaagctagccaaactgtaagaaacaagccatctattttaaagctatccagggcttaacctatatgaactctatttatcatgtctaatgcatgtgatttaatgtatgtttaatttgatatcatgttttaaaatatcctacttctggtagccatttaattcctccccctacccccaaataaatcaggcatgcaggaggcctgatatttagtaatgtcattgtgtttgaccttgaaggaaaatgctattagtccgtcgtgcttgatttgtttttgtccttgaataagcatgttatgtatattgtctcgtgtttttatttttacaccatattgtattacacttttagtattcaccagcataatcactgtctgcctaaaatatgcaactctttgcattacaatatgaagtaaagttctatgaagtatgcattttgtgtaactaatgtaaaaacacaaattttataaaattgtacagttttttaaaaactactcacaactagcagatggcttaaatgtagcaatctctgcgttaattaaatgcctttaagagatataattaacgtgcagttttaatatctactaaattaagaatgacttcattatgatcatgatttgccacaatgtccttaactctaatgcctggactggccatgttctagtctgttgcgctgttacaatctgtattggtgctagtcagaaaattcctagctcacatagcccaaaagggtgcgagggagaggtggattaccagtattgttcaataatccatggttcaaagactgtataaatgcattttattttaaataaaagcaaaacttttattt

SEQ ID NO: 87 - DNA, 2114 bp, Homo sapiens
gtgctgactacaagggcaacccagctctcagaggaactggcccagctccgggatgcctatcagaagcagaaggagcagctgcggcaacaactagaagcccctccaagccagagggatgggcactttctccaggaaagccggcgactctctgcccagtttgaaaatctcatggcagagagccgccaggacctggaggaggagtatgagcctcagttcctgcggctcctagagaggaaagaagctgggaccaaagctctgcagagaacccaggctgagatccaggaaatgaaggaggctctgagacccctgcaagcagaggcccggcagctccgcctgcaaaacaggaacctggaggaccagatcgcacttgtgaggcaaaaacgagatgaagaggtgcagcagtacagggaacagctggaggaaatggaagaacgccagaggcagttaagaaatggggtgcaactccagcaacagaagaacaaagagatggaacagctaaggctcagtcttgctgaagagctctctacttataaggctatgctactacccaagagcctggaacaggctgatgctcccacttctcaggcaggtggaatggagacacagtctcaaggggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtggaagttgcaaatactggctgacctgcttaaaaagattctagagttggccggaggcagaacatgtcaactctttgctggattctatttcatctgctgttgatactgatctcaatgcaccaaggaaaggaaagatgagcctcctgtcttccagcaacaaccctcacatatgcactgagtaaaggatgaatgtatggacacatctgggagtattttaaagaatgtatcttgccttgtgttgacccaaaccaaaaacatttttgaggggcacatgtggggtcaaaaagatagccaatttccattacatgggtttacaatttccattcttttgtgccacgagtgttagaatttaaatgaatacttttacaaagtctactttttgttcaaggatatgctgacccatatagtttactcttaaaattgtgtcaaggtatttctcactatactctaaaacaactagacttgaaaagaaaccatttgagatttgaatctaatggttaacgctattcagattttcccaaagatcttacctcatgaaagtagttctgggtcagaatgatctactcagttaaaaaacaacaacaacaaaaaactaagcgattgggaaaaaacaggaattttatctggttattgcatctggtgatagaggccttcaaagcctattatttctaacctaagtaaaggccccagtgaaaaacatactggggaaataaaacctctgagaaaaggttcaagcaccttttccaaatttaaatcttgccttaaattctctctaccacactgcctttgacactcttggaagtccatgtagttctctacagacagacttcaaagaaacgttaccttatcaaagactaatctgtgccacctctgattcagtgttttatgtctttcactttccctgggaaggagtaaagttcttttctacagctctgggactattacatttaattctgctcttgatagtcaaagaccatggacaacaactgtcatctgaaggactcttctagaagccagagactggtgtttgatggatgttttatactaaataaaacccatcagcatggggttatgtagaaaagcaatttattccattttaagcacttacacagttagtcatggagagtaacaggcctgctggtgaaacaggtcacccaaaatggagatggcatcaaactagtggtcaaggactaactcctaaaaaaaaaaagcaactcttatcaaggattaatttaatttttaaaacaaatacaagttattgattcactcttcccaacttgacagtctacctgtggtataactgtcaggtaaaaacatacatctttacaacttggtggtcccaagttaaaaaaaaaaaaaaaaa

SEQ ID NO: 88 - DNA, 5406 bp, Homo sapiens
cagttcgggaacatgttggcctcgagcagccggatccgggctgcgtggacgcgggcgctgctgctgccgctgctgctggcggggcctgtgggctgcctgagccgccaggagctctttcccttcggccccggacagggggacctggagctggaggacggggatgacttcgtctctcctgccctggagctgcgtggggcgctccgcttctacgacagatccgacatcgacgcagtctacgtcaccacaaatggcatcattgctacgagtgaacccccggccaaagaatcccatcccgggctcttcccaccaacattcggtgcagtcgcccctttcctggcggacttggacacgaccgatggcctggggaaggtttattatcgagaagacttatccccctccatcactcagcgagcagcagagtgtgtccacagagggttcccggagatctctttccagcctagtagcgcggtggttgtcacttgggaatccgtggccccctaccaagggcccagcagggacccagaccagaaaggcaagagaaacacgttccaggctgttctagcctcctctgattccagctcctatgccattttcctttatcctgaggatggtctgcagttccatacgacattctcaaagaaggaaaacaaccaagttcctgccgtggttgcattcagtcaaggttcagtgggattcttatggaagagcaacggagcttataacatatttgctaatgacagggaatcaattgaaaatttggccaagagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttgttttcagctataacacggattcccgccagacgtgtgctaacaacagacaccagtgctcggtgcacgcagagtgcagggactacgccacgggcttctgctgcagctgtgtcgctggctatacgggcaatggcaggcaatgtgttgcagaaggttccccccagcgagtcaatggcaaggtgaaaggaaggatctttgtggggagcagccaggtccccattgtctttgagaacactgacctccactcttacgtagtaatgaaccacgggcgctcctacacagccatcagcaccattcccgagaccgttggatattctctgcttccactggccccagttggaggcatcattggatggatgtttgcagtggagcaggacggattcaagaatgggttcagcatcaccgggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctatgctctcagcaactccattgggcctgtgagggaaggctcccctgatgctcttcagaatccctgctacatcggcactcatgggtgtgacaccaacgcggcctgtcgccctggtcccaggacacagttcacctgcgagtgctccatcggcttccgaggagacgggcgaacctgctatgaggtggagaaaacccggtgccagcacgagcgagaacacattctcggggcggcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtctgagtacagtggctcccccgattcaccaaggacctgcggtgcctaccgccgtgatccccttgcctcctgggacccatttactctttgcccagactgggaagattgagcgcctgcccctggagggaaataccatgaggaagacagaagcaaaggcgttccttcatgtcccggctaaagtcatcattggactggcctttgactgcgtggacaagatggtttactggacggacatcactgagccttccattgggagagctagtctacatggtggagagccaaccaccatcattagacaagatcttggaagtccagaaggtatcgctgttgatcaccttggccgcaacatcttctggacagactctaacctggatcgaatagaagtggcgaagctggacggcacgcagcgccgggtgctctttgagactgacttggtgaatcccagaggcattgtaacggattccgtgagagggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggcaccaatcgggcggaatgcctgaaccccagtcagcccagcagacgcaaggctctcgaagggctccagtatccttttgctgtgacgagctacgggaagaatctgtatttcacagactggaagatgaattccgtggttgctctcgatcttgcaatttccaaggagacggatgctttccaaccccacaagcagacccggctgtatggcatcaccacggccctgtctcagtgtccgcaaggccataactactgctcagtgaacaatggcggctgcacccacctatgcttggccaccccagggagcaggacctgccgttgccctgacaacaccttgggagttgactgtatcgaacagaaatgaagacaagagtgccttatttcctttccaagtatttcacagcaacactctacttgaagcaacttggtccagattgaaaagtgtcctctggctgagtggccactaggcccagacccagcccagcctgagccccaacaacttttccctcactgttccccaaaacatgcaccctggacttctctaatagaaaagtctccacccctacacaaggacagaaccctccacccctacccccaaccctcagacagacttatacacccctgagtgaggattacatgcccatcccagtgtcctaggaccttttcccaatactagccccccagtggtgaacagaacctcccaaatttgagttgcacccttccctgtggccttatgagctcagcctcgctttgaggtacccaccgtcctgtcagctccttgacctatgagccggggcctgactaggaaaagttgggagttaaggaggaaattagcattccttaatgttttgttttggtgctctgaatttcttctttattatagtcctatagttttactcctcagttcctcaccatcatcatcttgtctaagacccccattataatattcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaaaaaaaaaaaaaa

SEQ ID NO: 89 - DNA, 2406 bp, Homo sapiens
gattctgtgtgtgtcctcagatgctcagccacagacctttgagggagtaaagggggcagacccacccaccttgcctccaggctctttccttcctggtcctgttctatggtggggctcccttgccagacttcagactgagaagtcagatgaagtttcaagaaaaggaaattggtgggtgacagagatgggtggaggggctggggaaaggctgtttacttcctcctgtctagtcggtttggtccctttagggctccggatatctttggtgacttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagtcgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggctttttgggagtaaaaatgtgtcttcagagactgtgaacatcaccatcactcaaggtttggcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatgataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 90 - DNA, 536 bp, Homo sapiens
ttttttttttttttttataaaaatggcacatttattgctacagaacgggcatgttcatgacttcatcgaataactacagatgggaaacaggtaatggccttgaccaagctgggtttgtttttgtcttgaaggaactccagcacacaacctgtttggacacttctacaaatcagaaatacaccaaaaacatgaaaaaatcgaggcactcagccacacattgaaaacaaggggtaactgtttatctttttttttttttgaaatgttttccctttttttctttttttaacaatttttttaagtttttaatgctgcagctatgtgtacagtcgcaaaaaatttccccgctgcgacctacaactaaaaacaaaaacaaaaacgaaaacaaaacaaaaaacaaacaaaaaagctacccatacagtttcatcttggtaacacatggtaaaataacatcttttaaatagtaaaataaagtaacaaacttttactcataatgattccaaaaatctacaaagaagaaatattcagaatctgacaat

SEQ ID NO: 91 - DNA, 2206 bp, Homo sapiens
agaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttaaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaataaaaaagaaaaagc

SEQ ID NO: 92 - DNA, 3960 bp, Homo sapiens
cacaggctgagcagtcaggcccacagcatctgaccccaggcccagctcgtcctggctggcctgggtcggcctctggagtatggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagcttgtgcccctggtcattttggggctgattgccgactccagtgccagtgtcagaatggtggcacttgtgaccggttcagtggttgtgtctgcccctctgggtggcatggagtgcactgtgagaagtcagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggccgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctccaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 93 - DNA, 2269 bp, Homo sapiens
tgggttggtgtttatctcctcccagccttgagggagggaacaacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgtttcagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagctgagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcaaaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacaaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacttaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgcattcttctgagcactgtttatacactgtgtaaatacccatatgtcct

SEQ ID NO: 94 - DNA, 1906 bp, Homo sapiens
gcggcggcggcggcggcggcggtgacggccgggaagggtcagttggaggcaggcgctcgctgaggcaaaaggaggcgctcggcccgcggcctgacagggacttagcccgcagagatcgaccccgcgcgcgtgaccccacacccacccactcatccatctatccactccctgcgccgcctcctcccaccctgagcagagccgccgaggatgataaacacccaggacagtagtattttgcctttgagtaactgtccccagctccagtgctgcaggcacattgttccagggcctctgtggtgctcctgatgcccctcacccactgtcgaagatccccggtgggcgagggggcggcagggatccttctctctcagctctaatatataaggacgagaagctcactgtgacccaggacctccctgtgaatgatggaaaacctcacatcgtccacttccagtatgaggtcaccgaggtgaaggtctcttcttgggatgcagtcctgtccagccagagcctgtttgtagaaatcccagatggattattagctgatgggagcaaagaaggattgttagcactgctagagtttgctgaagagaagatgaaagtgaactatgtcttcatctgcttcaggaagggccgagaagacagagctccactcctgaagaccttcagcttcttgggctttgagattgtacgtccaggccatccctgtgtcccctctcggccagatgtgatgttcatggtttatcccctggaccagaacttgtccgatgaggactaatagtcatagaggatgctttacccaagagccacagtgggggaagaggggaagttaggcagccctgggacagacgagagggctcctcgctgtctagggaaggacactgaggggctcagggtgagggttgcctattgtgttctcggagttgactcgttgaaattgttttccataaagaacagtataaacatattattcacatgtaatcaccaatagtaaatgaagatgtttatgaactggcattagaagctttctaaactgcgctgtgtgatgtgttctatctagcctaggggaggacattgcctagagggggagggactgtctgggttcaggggcatggcctggagggctggtgggcagcactgtcaggctcaggtttccctgctgttggctttctgttttggttattaagacttgtgtattttctttctttgcttcctgtcaccccaggggctcctgagtataggcttttcagtccctgggcagtgtccttgagttgttttttgacactcttacctgggcttctctgtgtgcatttgcgtctggcctggagtaagcaggtccgacccctcgttctttacagcttagtgttattctggcatttggttaagctggcttaatcttgtttaatgttatcagtacattttaaataggggcattgaaatttactcccaccaccagggcttttttgggggatgcctgggcctttaaaacactagccaaactctaattaattctcaaatcactgccaggagttcttgctcctggctgcaggcccaggccccaaggtctccttcttggggtcacaaacagcagtaaggaagaggaatatatagcaactcagggcctgggaattgtggggcaatccgttcttagggactggatacttctggctggctgagtatagtactagctgcctccccaccaggttccgagtagtgtctgagactctgctctgcagggcctagggtagcgctgggagtgtagaagtggcctgcccttaactgttttcactaaacagctttttctaaggggagagcaagggggagagatctagattgggtgagggggacggggatgtcagggaggcaagtgtgttgtgttactgtgtcaataaactgatttaaagtt

SEQ ID NO: 95 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 96 - protein, 333 aa, Homo sapiens
MGDWGFLEKLLDQVQEHSTVVGKIWLTVLFIFRILILGLAGESVWGDEQSDFECNTAQPGCTNVCYDQAFPISHIRYWVLQFLFVSTPTLVYLGHVIYLSRREERLRQKEGELRALPAKDPQVERALAAVERQMAKISVAEDGRLRIRGALMGTYVASVLCKSVLEAGFLYGQWRLYGWTMEPVFVCQRAPCPYLVDCFVSRPTEKTIFIIFMLVVGLISLVLNLLELVHLLCRCLSRGMRARQGQDAPPTQGTSSDPYTDQVFFYLPVGQGPSSPPCPTYNGLSSSEQNWANLTTEERLASSRPPLFLDPPPQNGQKPPSRPSSSASKKQYV

SEQ ID NO: 97 - protein, 652 aa, Homo sapiens
MATSMGLLLLLLLLLTQPGAGTGADTEAVVCVGTACYTAHSGKLSAAEAQNHCNQNGGNLATVKSKEEAQHVQRVLAQLLRREAALTARMSKFWIGLQREKGKCLDPSLPLKGFSWVGGGEDTPYSNWHKELRNSCISKRCVSLLLDLSQPLLPNRLPKWSEGPCGSPGSPGSNIEGFVCKFSFKGMCRPLALGGPGQVTYTTPFQTTSSSLEAVPFASAANVACGEGDKDETQSHYFLCKEKAPDVFDWGSSGPLCVSPKYGCNFNNGGCHQDCFEGGDGSFLCGCRPGFRLLDDLVTCASRNPCSSSPCRGGATCVLGPHGKNYTCRCPQGYQLDSSQLDCVDVDECQDSPCAQECVNTPGGFRCECWVGYEPGGPGEGACQDVDECALGRSPCAQGCTNTDGSFHCSCEEGYVLAGEDGTQCQDVDECVGPGGPLCDSLCFNTQGSFHCGCLPGWVLAPNGVSCTMGPVSLGPPSGPPDEEDKGEKEGSTVPRAATASPTRGPEGTPKATPTTSRPSLSSDAPITSAPLKMLAPSGSSGVWREPSIHHATAASGPQEPAGGDSSVATQNNDGTDGQKLLLFYILGTVVAILLLLALALGLLVYRKRRAKREEKKEKKPQNAADSYSWVPERAESRAMENQYSPTPGTDC

SEQ ID NO: 98 - protein, 784 aa, Homo sapiens
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFTLNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 99 - protein, 1346 aa, Homo sapiens
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHMGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSTVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 100 - protein, 461 aa, Homo sapiens [sequence omitted]

SEQ ID NO: 101 - protein, 380 aa, Homo sapiens
MEEGGDFDNYYGADNQSECEYTDWKSSGALIPAIYMLVFLLGTTGNGLVLWTVFRSSREKRRSADIFIASLAVADLTFVVTLPLWATYTYRDYDWPFGTFFCKLSSYLIFVNMYASVFCLTGLSFDRYLAIVRPVANARLRLRVSGAVATAVLWVLAALLAMPVMVLRTTGDLENTTKVQCYMDYSMVATVSSEWAWEVGLGVSSTTVGFVVPFTIMLTCYFFIAQTIAGHFRKERIEGLRKRRRLLSIIVVLVVTFALCWMPYHLVKTLYMLGSLLHWPCDFDLFLMNIFPYCTCISYVNSCLNPFLYAFFDPRFRQACTSMLCCGQSRCAGTSHSSSGEKSASYSSGHSQGPGPNMGKGGEQMHEKSIPYSQETLVVD

SEQ ID NO: 102 - protein, 949 aa, Homo sapiens
MILSLLFSLGGPLGWGLLGAWAQASSTSLSDLQSSRTPGVWKAEAEDTSKDPVGRNWCPYPMSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRVGQLRQDVEDRLHAQHFTLHRSISELQADVDTKLKRLHKAQEAPGTNGSLVLATPGAGARPEPDSLQARLGQLQRNLSELHMTTARREEELQYTLEDMRATLTRHVDEIKELYSESDETFDQISKVERQVEELQVNHTALRELRVILMEKSLIMEENKEEVERQLLELNLTLQHLQGGHADLIKYVKDCNCQKLYLDLDVIREGQRDATRALEETQVSLDERRQLDGSSLQALQNAVDAVSLAVDAHKAEGERARAATSRLRSQVQALDDEVGALKAAAAEARHEVRQLHSAFAALLEDALRHEAVLAALFGEEVLEEMSEQTPGPLPLSYEQIRVALQDAASGLQEQALGWDELAARVTALEQASEPPRPAEHLEPSHDAGREEAATTALAGLARELQSLSNDVKNVGRCCEAEAGAGAASLNASLDGLHNALFATQRSLEQHQRLFHSLFGNFQGLMEANVSLDLGKLQTMLSRKGKKQQKDLEAPRKRDKKEAEPLVDIRVTGPVPGALGAALWEAGSPVAFYASFSEGTAALQTVKFNTTYINIGSSYFPEHGYFRAPERGVYLFAVSVEFGPGPGTGQLVFGGHHRTPVCTTGQGSGSTATVFAMAELQKGERVWFELTQGSITKRSLSGTAFGGFLMFKT

SEQ ID NO: 103 - protein, 690 aa, Homo sapiens [sequence omitted]

SEQ ID NO: 104 - protein, 97 aa, Homo sapiens
MKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 105 - protein, 382 aa, Homo sapiens
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 106 - protein, 652 aa, Homo sapiens; identical to SEQ ID NO: 97

SEQ ID NO: 107 - protein, 1403 aa, Homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 108 - protein, 1388 aa, Homo sapiens
MAPRRNNGQCWCLLMLLSVSTPLPAVTQTRGATETASQGHLDLTQLIGVPLPSSVSFVTGYGGFPAYSFGPGANVGRPARTLIPSTFFRDFAIRVVVKPSSTRGGVLFAITDAFQKVIYLGLRLSGVEDGHQRIILYYTEPGSHVSQEAAAFSVPVMTHRWNRFAMIVQGEEVTLLVNCEEHSRIPFQRSSQALAFESSAGIFMGNAGATGLERFTGSLQQLTVHPDPRTPEELCDPEESSASGETSGLQEADGVAEILEAVTYTQASPKEAKVEPINTPPTPSSPFEDMELSGEPVPEGTLETTNMSIIQHSSPKQGSGEILNDTLEGVHSVDGDPITDSGSGAGAFLDIAEEKNLAATAAGLAEVPISTAGEAEASSVPTGGPTLSMSTENPEEGVTPGPDNEERLRATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSRPTAAIGLKGEKGDRGPKGERGMDGASIVGPPGPRGPPGHIKVLSNSLINITHGFMNFSDIPELVGPPGPDGLPGLPGFPGPRGPKGDTGLPGFPGLKGEQGEKGEPGAILTEDIPLERLMGKKGEPGMHGAPGPMGPKGPPGHKGEFGLPGRPGRPGLNGLKGTKGDPGVIMQGPPGLPGPPGPPGPPGAVINIKGAIFPIPVRPHCKMPVDTAHPGSPELITFHGVKGEKGSWGLPGSKGEKGDQGAQGPPGPPLDLAYLRHFLNNLKGENGDKGFKGEKGEKGDINGSFLMSGPPGLPGNPGPAGQKGETVVGPQGPPGAPGLPGPPGFGRPGDPGPPGPPGPPGPPAILGAAVALPGPPGPPGQPGLPGSRNLVTAFSNMDDMLQKAHLVIEGTFIYLRDSTEFFIRVRDGWKKLQLGELIPIPADSPPPPALSSNPHQLLPPPNPISSANYEKPALHLAALNMPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 109 - protein, 20 aa, Homo sapiens
ACGACCGCTCAGTCTCCTCT

SEQ ID NO: 110 - protein, 1101 aa, Homo sapiens
MDLILINSLPLVSDAETSLTCIASGWRPHEPITIGRDFEALMNQHQDPLEVTQDVTREWAKKVVWKREKASKINGAYFCEGRVRGEAIRIRTMKMRQQASFLPATLTMTVDKGDNVNISFKKVLIKEEDAVIYKNGSFIHSVPRHEVPDILEVHLPHAQPQDAGVYSARYIGGNLFTSAFTRLIVRRCEAQKWGPECNHLCTACMNNGVCHEDTGECICPPGFMGRTCEKACELHTFGRTCKERCSGQEGCKSYVFCLPDPYGCSCATGWKGLQCNEACHPGFYGPDCKLRCSCNNGEMCDRFQGCLCSPGWQGLQCEREGIPRMTPKIVDLPDHIEVNSGKFNPICKASGWPLPTNEEMTLVKPDGTVLHPKDFNHTDHFSVAIFTIHRILPPDSGVWVCSVNTVAGMVEKPFNISVKVLPKPLNAPNVIDTGHNFAVINISSEPYFGDGPIKSKKLLYKPVNHYEAWQHIQVTNEIVTLNYLEPRTEYELCVQLVRRGEGGEGHPGPVRRFTTASIGLPPPRGLNLLPKSQTTLNLTWQPIFPSSEDDFYVEVERRSVQKSDQQNIKVPGNLTSVLLNNLHPREQYVVRARVNTKAQGEWSEDLTAWTLSDILPPQPENIKISNITHSSAVISWTILDGYSISSITIRYKVQGKNEDQHVDVKIKNATITQYQLKGLEPETAYQVDIFAENNIGSSNPAFSHELVTLPESQAPADLGGGKMLLIAILGSAGMTCLTVLLAFLIILQLKRANVQRRMAQAFQNVREEPAVQFNSGTLALNRKVKNNPDPTIYPVLDWNDIKFQDVIGEGNFGQVLKARIKKDGLRMDAAIKRMKEYASKDDHRDFAGELEVLCKLGHHPNIINLLGACEHRGYLYLAIEYAPHGNLLDFLRKSRVLETDPAFAIANSTASTLSSHHLLHFAADVARGMDYLSQKQFIHRDLAARNILVGENYVAKIADFGLSRGQEVYVKKTMGRLPVRWMAIESLNYSVYTTNSDVWSYGVLLWEIVSLGGTPYCGMTCAELYEKLPQGYRLEKPLNCDDEVYDLMRQCWREKPYERPSFAQILVSLNRMLEERKTYVNTTLYEKFTYAGIDCSAEEAA

SEQ ID NO: 111 - protein, 99 aa, Homo sapiens
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 112 - protein, 424 aa, Homo sapiens
MLARKSIIPEEYVLARIAAENLRKPRIRDRLPKARFIAKSGACNLAHKNIREQGRFLQDIFTTLVDLKWRHTLVIFTMSFLCSWLLFAIMWWLVAFAHGDIYAYMEKSGMEKSGLESTVCVTNVRSFTSAFLFSIEVQVTIGFGGRMMTEECPLAITVLILQNIVGLIINAVMLGCIFMKTAQAHRRAETLIFSRHAVIAVRNGKLCFMFRVGDLRKSMIISASVRIQVVKKTTTPEGEVVPIHQLDIPVDNPIESNNIFLVAPLIICHVIDKRSPLYDISATDLANQDLEVIVILEGVVETTGITTQARTSYIAEEIQWGHRFVSIVTEEEGVYSVDYSKFGNTVKVAAPRCSARELDEKPSILIQTLQKSELSHQNSLRKRNSMRRNNSMRRNNSIRRNNSSLMVPKVQFMTPEGNQNTSES

SEQ ID NO: 113 - protein, 73 aa, Homo sapiens
MPALHIEDLPEKEKLKMEVEQLRKEVKLQRQQVSKCSEEIKNYIEERSGEDPLVKGIPEDKNPFKEKGSCVIS

SEQ ID NO: 114 - protein, 889 aa, Homo sapiens
MYLSICCCFLLWAPALTLKNLNYSVPEEQGAGTVIGNIGRDARLQPGLPPAERGGGGRSKSGSYRVLENSAPHLLDVDADSGLLYTKQRIDRESLCRHNAKCQLSLEVFANDKEICMIKVEIQDINDNAPSFSSDQIEMDISENAAPGTRFPLTSAHDPDAGENGLRTYLLTRDDHGLFGLDVKSRGDGTKFPELVIQKALDREQQNHHTLVLTALDGGEPPRSATVQINVKVIDSNDNSPVFEAPSYLVELPENAPLGTVVIDLNATDADEGPNGEVLYSFSSYVPDRVRELFSIDPKTGLIRVKGNLDYEENGMLEIDVQARDLGPNPIPAHCKVTVKLIDRNDNAPSIGFVSVRQGALSEAAPPGTVIALVRVTDRDSGKNGQLQCRVLGGGGTGGGGGLGGPGGSVPFKLEENYDNFYTVVTDRPLDRETQDEYNVTIVARDGGSPPLNSTKSFAIKILDENDNPPRFTKGLYVLQVHENNIPGEYLGSVLAQDPDLGQNGTVSYSILPSHIGDVSIYTYVSVNPTNGAIYALRSFNFEQTKAFEFKVLAKDSGAPAHLESNATVRVTVLDVNDNAPVIVLPTLQNDTAELQVPRNAGLGYLVSTVRALDSDFGESGRLTYEIVDGNDDHLFEIDPSSGEIRTLHPFWEDVTPVVELVVKVTDHGKPTLSAVAKLIIRSVSGSLPEGVPRVNGEQHHWDMSLPLIVTLSTISIILLAAMITIAVKCKRENKEIRTYNCRIAEYSHPQLGGGKGKKKKINKNDIMLVQSEVEERNAMNVMNVVSSPSLATSPMYFDYQTRLPLSSPRSEVMYLKPASNNLTVPQGHAGCHTSFTGQGTNASETPATRMSIIQTDNFPAEPNYMGSRQQFVQSISVAPRLRTQKEPA

SEQ ID NO: 115 - protein, 738 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQVLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKANKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVGNHAMKPINDNKEPLNSDVQYTEVQVSSAESHKDLGKKDTETVYSEVRKAVPDAVESRYSRTEGSLDGT

SEQ ID NO: 116 - protein, 311 aa, Homo sapiens
MQNYKYDKAIVPESKNGGSPALNNNPRRSGSKRVLLICLDLFCLFMAGLPFLIIETSTIKPYHRGFYCNDESIKYPLKTGETINDAVLCAVGIVIAILAIITGEFYRIYYLKKSRSTIQNPYVAALYKQVGCFLFGCAISQSFTDIAKVSIGRLRPHFLSVCNPDFSQINCSEGYIQNYRCRGDDSKVQEARKSFFSGHASFSMYTMLYLVLYLQARFTWRGARLLRPLLQFTLIMMAFYTGLSRVSDHKHHPSDVLAGFAQGALVACCIVFFVSDLFKTKTTLSLPAPAIRKEILSPVDIIDRNNHHNMM

SEQ ID NO: 117 - protein, 738 aa, Homo sapiens; identical to SEQ ID NO: 115

SEQ ID NO: 118 - protein, 1603 aa, Homo sapiens
MWVSWAPGLWLLGLWATFGHGANTGAQCPPSQQEGLKLEHSSSLPANVTGFNLIHRLSLMKKSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVRARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPGEKGPRGEKGEPGECSCPSQGDLIFSGMPGAPGLWMGSSWQPGPQGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFTGPTGSPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 119 - protein, 742 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHENVMWLKPESTSHTLI

SEQ ID NO: 120 - protein, 738 aa, Homo sapiens; identical to SEQ ID NO: 115

SEQ ID NO: 121 - protein, 148 aa, Homo sapiens
METGALRRPQLLPLLLLLCGGCPRAGGCNETGMLERLPLCGKAFADMMGKVDVWKWCNLSEFIVYYESFTNCTEMEANVVGCYWPNPLAQGFITGIHRQFFSNCTVDRVHLEDPPDEVLIPLIVIPVVLTVAMAGLVVWRSKRTDTLL

SEQ ID NO: 122 - protein, 646 aa, Homo sapiens [sequence omitted]

SEQ ID NO: 123 - protein, 667 aa, Homo sapiens
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 124 - protein, 646 aa, Homo sapiens
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGEKYIDLRH

SEQ ID NO: 125 - protein, 476 aa, Homo sapiens
MAGRGGSALLALCGALAACGWLLGAEAQEPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 126 - protein, 442 aa, Homo sapiens
MGLAMEHGGSYARAGGSSRGCWYYLRYFFLFVSLIQFLIILGLVLFMVYGNVHVSTESNLQATERRAEGLYSQLLGLTASQSNLTKELNFTTRAKDAIMQMWLNARRDLDRINASFRQCQGDRVIYTNNQRYMAAIILSEKQCRDQFKDMNKSCDALLFMLNQKVKTLEVEIAKEKTICTKDKESVLLNKRVAEEQLVECVKTRELQHQERQLAKEQLQKVQALCLPLDKDKFEMDLRNLWRDSIIPRSLDNLGYNLYHPLGSELASIRRACDHMPSLMSSKVEELARSLRADIERVARENSDLQRQKLEAQQGLRASQEAKQKVEKEAQAREAKLQAECSRQTQLALEEKAVLRKERDNLAKELEEKKREAEQLRMELAIRNSALDTCIKTKSQPMMPVSRPMGPVPNPQPIDPASLEEFKRKILESQRPPAGIPVAPSSG

SEQ ID NO: 127 - protein, 1669 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMPGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 128 - protein, 176 aa, Homo sapiens
MRKHLSWWWLATVCMLLFSHLSAVQTRGIKHRIKWNRKALPSTAQITEAQVAENRPGAFIKQGRKLDIDFGAEGNRYYEANYWQFPDGIHYNGCSEANVTKEAFVTGCINATQAANQGEFQKPDNKLHQQVLWRLVQELCSLKHCEFWLERGAGLRVTMHQPVLLCLLALIWLTVK

SEQ ID NO: 129 - protein, 646 aa, Homo sapiens; identical to SEQ ID NO: 124

SEQ ID NO: 130 - protein, 261 aa, Homo sapiens
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 131 - protein, 284 aa, Homo sapiens
MFDKTRLPYVALDVLCVLLAGLPFAILTSRHTPFQRGVFCNDESIKYPYKEDTIPYALLGGIIIPFSIIVIILGETLSVYCNLLHSNSFIRNNYIATIYKAIGTFLFGAAASQSLTDIAKYSIGRLRPHFLDVCDPDWSKINCSDGYIEYYICRGNAERVKEGRLSFYSGHSSFSMYCMLFVALYLQARMKGDWARLLRPTLQFGLVAVSIYVGLSRVSDYKHHWSDVLTGLIQGALVAILVAVYVSDFFKERTSFKERKEEDSHTTLHETPTTGNHYPSNHQP

SEQ ID NO: 132 - protein, 1496 aa, Homo sapiens
SRPWWLRASERPSAPSAMAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVCSNDPPCFSVMIPPNDSRARSGARCMFFVRSSPVCGSGMTSLLMNSVYPREQINQLTSYIDASNVYGSTEHEARSIRDLASHRGLLRQGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 133 - protein, 2813 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDIQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPHMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 134 - protein, 468 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 135 - protein, 277 aa, Homo sapiens
MIILIYLFLLLWEDTQGWGFKDGIFHNSIWLERAAGVYHREARSGKYKLTYAEAKAVCEFEGGHLATYKQLEAARKIGFHVCAAGWMAKGRVGYPIVKPGPNCGFGKTGIIDYGIRLNRSERWDAYCYNPHAKECGGVFTDPKQIFKSPGFPNEYEDNQICYWHIRLKYGQRIHLSFLDFDLEDDPGCLADYVEIYDSYDDVHGFVGRYCGDELPDDIISTGNVMTLKFLSDASVTAGGFQIKYVAMDPVSKSSQGKNTSTTSTGNKNFLAGRFSHL

SEQ ID NO: 136 - protein, 1502 aa, Homo sapiens
REIACIQKDKDIPAEDIICEYFEPKPLLEQACLIPCQQDCIVSEFSAWSECSKTCGSGLQHRTRHVVAPPQFGGSGCPNLTEFQVCQSSPCEAEELRYSLHVGPWSTCSMPHSRQVRQARRRGKNKEREKDRSKGVKDPEARELIKKKRNRNRQNRQENKYWDIQIGYQTREVMCINKTGKAADLSFCQQEKLPMTFQSCVITKECQVSEWSEWSPCSKTCHDMVSPAGTRVRTRTIRQFPIGSEKECPEFEEKEPCLSQGDGVVPCATYGWRTTEWTECRVDPLLSQQDKRRGNQTALCGGGIQTREVYCVQANENLLSQLSTHKNKEASKPMDLKLCTGPIPNTTQLCHIPCPTECEVSPWSAWGPCTYENCNDQQGKKGFKLRKRRITNEPTGGSGVTGNCPHLLEAIPCEEPACYDWKAVRLGDCEPDNGKECGPGTQVQEVVCINSDGEEVDRQLCRDAIFPIPVACDAPCPKDCVLSTWSTWSSCSHTCSGKTTEGKQIRARSILAYAGEEGGIRCPNSSALQEVRSCNEHPCTVYHWQTGPWGQCIEDTSVSSFNTTTTWNGEASCSVGMQTRKVICVRVNVGQVGPKKCPESLRPETVRPCLLPCKKDCIVTPYSDWTSCPSSCKEGDSSIRKQSRHRVIIQLPANGGRDCTDPLYEEKACEAPQACQSYRWKTHKWRRCQLVPWSVQQDSPGAQEGCGPGRQARAITCRKQDGGQAGIHECLQYAGPVPALTQACQIPCQDDCQLTSWSKFSSCNGDCGAVRTRKRTLVGKSKKKEKCKNSHLYPLIETQYCPCDKYNAQPVGNWSDCILPEGKVEVLLGMKVQGDIKECGQGYRYQAMACYDQNGRLVETSRCNSHGYIEEACIIPCPSDCKLSEWSNWSRCSKSCGSGVKVRSKWLREKPYNGGRPCPKLDHVNQAQVYEVVPCHSDCNQYLWVTEPWSICKVTFVNMRENCGEGVQTRKVRCMQNTADGPSEHVEDYLCDPEEMPLGSRVCKLPCPEDCVISEWGPWTQCVLPCNQSSFRQRSADPIRQPADEGRSCPNAVEKEPCNLNKNCYHYDYNVTDWSTCQLSEKAVCGNGIKTRMLDCVRSDGKSVDLKYCEALGLEKNWQMNTSCMVECPVNCQLSDWSPWSECSQTCGLTGKMIRRRTVTQPFQGDGRPCPSLMDQSKPCPVKPCYRWQYGQWSPCQVQEAQCGEGTRTRNISCVVSDGSADDFSKVVDEEFCADIELIIDGNKNMVLEESCSQPCPGDCYLKDWSSWSLCQLTCVNGEDLGFGGIQVRSRPVIIQELENQHLCPEQMLETKSCYDGQCYEYKWMASAWKGSSRTVWCQRSDGINVTGGCLVMSQPDADRSCNPPCSQPHSYCSETKTCHCEEGYTEVMSSNSTLEQCTLIPVVVLPTMEDKRGDVKTSRAVHPTQPSSNPAGRGRTWFLQPFGPDGRLKTWVYGVAAGAFVLLIFIVSMIYLACKKPKKPQRRQNNRLKPLTLAYDGDADM

SEQ ID NO: 137 - protein, 1816 aa, Homo sapiens
MALSSAWRSVLPLWLLWSAACSRAASGDDNAFPFDIEGSSAVGRQDPPETSEPRVALGRLPPAAEKCNAGFFHTLSGECVPCDCNGNSNECLDGSGYCVHCQRNTTGEHCEKCLDGYIGDSIRGAPQFCQPCPCPLPHLANFAESCYRKNGAVRCICNENYAGPNCERCAPGYYGNPLLIGSTCKKCDCSGNSDPNLIFEDCDEVTGQCRNCLRNTTGFKCERCAPGYYGDARIAKNCAVCNCGGGPCDSVTGECLEEGFEPPTGCDKCVWDLTDDLRLAALSIEEGKSGVLSVSSGAAAHRHVNEINATIYLLKTKLSERENQYALRKIQINNAENTMKSLLSDVEELVEKENQASRKGQLVQKESMDTINHASQLVEQAHDMRDKIQEINNKMLYYGEEHELSPKEISEKLVLAQKMLEEIRSRQPFFTQRELVDEEADEAYELLSQAESWQRLHNETRTLFPVVLEQLDDYNAKLSDLQEALDQALNHVRDAEDMNRATAARQRDHEKQQERVREQMEVVNMSLSTSADSLTTPRLTLSELDDIIKNASGIYAEIDGAKSELQVKLSNLSNLSHDLVQEAIDHAQDLQQEANELSRKLHSSDMNGLVQKALDASNVYENIVNYVSEANETAEFALNTTDRIYDAVSGIDTQIIYHKDESENLLNQARELQAKAESSSDEAVADTSRRVGGALARKSALKTRLSDAVKQLQAAERGDAQQRLGQSRLITEEANRTTMEVQQATAPMANNLTNWSQNLQHFDSSAYNTAVNSARDAVRNLTEVVPQLLDQLRTVEQKRPASNVSASIQRIRELIAQTRSVASKIQVSMMFDGQSAVEVHSRTSMDDLKAFTSLSLYMKPPVKRPELTETADQFILYLGSKNAKKEYMGLAIKNDNLVYVYNLGTKDVEIPLDSKPVSSWPAYFSIVKIERVGKHGKVFLTVPSLSSTAEEKFIKKGEFSGDDSLLDLDPEDTVFYVGGVPSNFKLPTSLNLPGFVGCLELATLNNDVISLYNFKHIYNMDPSTSVPCARDKLAFTQSRAASYFFDGSGYAVVRDITRRGKFGQVTRFDIEVRTPADNGLILLMVNGSMFFRLEMRNGYLHVFYDFGFSSGRVHLEDTLKKAQINDAKYHEISIIYHNDKKMILVVDRRHVKSMDNEKMKIPFTDIYIGGAPPEILQSRALRAHLPLDINFRGCMKGFQFQKKDFNLLEQTETLGVGYGCPEDSLISRRAYFNGQSFIASIQKISFFDGFEGGFNFRTLQPNGLLFYYASGSDVFSISLDNGTVIMDVKGIKVQSVDKQYNDGLSHFVISSVSPTRYELIVDKSRVGSKNPTKGKIEQTQASEKKFYFGGSPISAQYANFTGCISNAYFTRVDRDVEVEDFQRYTEKVHTSLYECPIESSPLFLLHKKGKNLSKPKASQNKKGGKSKDAPSWDPVALKLPERNTPRNSHCHLSNSPRAIEHAYQYGGTANSRQEFEHLKGDFGAKSQFSIRLRTRSSHGMIFYVSDQEENDFMTLFLAHGRLVYMFNVGHKKLKIRSQEKYNDGLWHDVIFIRERSSGRLVIDGLRVLEESLPPTEATWKIKGPIYLGGVAPGKAVKNVQINSIYSFSGCLSNLQLNGASITSASQTFSVTPCFEGPMETGTYFSTEGGYVVLDESFNIGLKFEIAFEVRPRSSSGTLVHGHSVNGEYLNVHMKNGQVIVKVNNGIRDFSTSVTPKQSLCDGRWHRITVIRDSNVVQLDVDSEVNHVVGPLNPKPIDHREPVFVGGVPESLLTPRLAPSKPFTGCIRHFVIDGHPVSFSKAALVSGAVSINSCPAA

SEQ ID NO: 138 - protein, 625 aa, Homo sapiens
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTREYPRPPQ

SEQ ID NO: 139 - protein, 114 aa, Homo sapiens
MSLPSSRAARVPGPSGSLCALLALLLLLTPPGPLASAGPVSAVLTELRCTCLRVTLRVNPKTIGKLQVFPAGPQCSKVEVVASLKNGKQVCLDPEAPFLKKVIQKILDSGNKKN

SEQ ID NO: 140 - protein, 275 aa, Homo sapiens
MGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLVKSRLKRLCSSEVGLLKNAEREQESEEEM

SEQ ID NO: 141 - protein, 311 aa, Homo sapiens; identical to SEQ ID NO: 116

SEQ ID NO: 142 - protein, 284 aa, Homo sapiens; identical to SEQ ID NO: 131

SEQ ID NO: 143 - protein, 604 aa, Homo sapiens
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKGKKQLPDSNEIVEKLLLRRKFIPDPQGSNMMFAFFAQHFTHQFFKTDHKRGPAFTNGLGHGVDLNHIYGETLARQRKLRLFKDGKMKYQIIDGEMYPPTVKDTQAEMIYPPQVPEHLRFAVGQEVFGLVPGLMMYATIWLREHNRVCDVLKQEHPEWGDEQLFQTSRLILIGETIKIVIEDYVQHLSGYHFKLKFDPELLFNKQFQYQNRIAAEFNTLYHWHPLLPDTFQIHDQKYNYQQFIYNNSILLEHGITQFVESFTRQIAGRVAGGRNVPPAVQKVSQASIDQSRQMKYQSFNEYRKRFMLKPYESFEELTGEKEMSAELEALYGDIDAVELYPALLVEKPRPDAIFGETMVEVGAPFSLKGLMGNVICSPAYWKPSTFGGEVGFQIINTASIQSLICNNVKGCPFTSFSVPDPELIKTVTINASSSRSGLDDINPTVLLKERSTEL

SEQ ID NO: 144 - protein, 1346 aa, Homo sapiens; identical to SEQ ID NO: 99

SEQ ID NO: 145 - protein, 311 aa, Homo sapiens; identical to SEQ ID NO: 116

SEQ ID NO: 146 - protein, 777 aa, Homo sapiens
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 147 - protein, 207 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 148 - protein, 519 aa, Homo sapiens
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 149 - protein, 476 aa, Homo sapiens; identical to SEQ ID NO: 125

SEQ ID NO: 150 - protein, 510 aa, Homo sapiens
MEDTKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 151 - protein, 1375 aa, Homo sapiens
MEGDRVAGRPVLSSLPVLLLLQLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYREDTSPAVLGLAARYVRAGFPRSARFTPTHAFLATWEQVGAYEEVKRGALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDNLDYYDVNEEEAEYLPGEPEEALNGHSSIDVSFQSKVDTKPLEESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASGHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVPANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 152 - protein, 282 aa, Homo sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGEGAEL

SEQ ID NO: 153 - protein, 193 aa, Homo sapiens
MPVWGGGNKCGACGRTVYHAEEVQCDGRSFHRCCFLCMVCRKNLDSTTVAIHDEEIYCKSCYGKKYGPKGYGYGQGAGTLNMDRGERLGIKPESVQPHRPTTNPNTSKFAQKYGGAEKCSRCGDSVYAAEKIIGAGKPWHKNCFRCAKCGKSLESTTLTEKEGEIYCKGCYAKNFGPKGFGYGQGAGALVHAQ

SEQ ID NO: 154 - protein, 366 aa, Homo sapiens
MWPLWLCWALWVLPLAGPGAALTEEQLLGSLLRQLQLSEVPVLDRADMEKLVIPAHVRAQYVVLLRRSHGDRSRGKRFSQSFREVAGRFLASEASTHLLVFGMEQRLPPNSELVQAVLRLFQEPVPKAALHRHGRLSPRSAQARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLRDYGAQGDCDPEAPMTEGTRCCRQEMYIDLQGMKWAKNWVLEPPGFLAYECVGTCQQPPEALAFNWPFLGPRQCIASETASLPMIVSIKEGGRTRPQVVSLPNMRVQKCSCASDGALVPRRLQP

SEQ ID NO: 155 - protein, 238 aa, Homo sapiens
MLTPLGKFSTAKFAVRLPRVWEARAPSLSGAPAPTPPAPPPSRSSRLGLWPRCFLIFPQLRILLLGPQESNNSTGTMWKVSALLFVLGSASLWVLAEGASTGQPEDDTETTGLEGGVAMPGAEDDVVTPGTSEDRYKSGLTTLVATSVNSVTGIRIEDLPTSESTVHAQEQSPSATASNVATSHSTEKVDGDTQTTVEKDGLSTVTLVGIIVGVLLAIGFIGAIIVVVMRKMSGRYSP

SEQ ID NO: 156 - protein, 23 aa, Homo sapiens
ATNGCYTCRTCRAANACRTTYTT

SEQ ID NO: 157 - protein, 170 aa, Homo sapiens
MEAPAELLAALPALATALALLLAWLLVRRGAAASPEPARAPPEPAPPAEATGAPAPSRPCAPEPAASPAGPEEPGEPAGLGELGEPAGPGEPEGPGDPAAAPAEAEEQAVEARQEEEQDLDGEKGPSSEGPEEEDGEGFSFKYSPGKLRGNQYKKMMTKEELEEEQRTEE

SEQ ID NO: 158 - protein, 277 aa, Homo sapiens; identical to SEQ ID NO: 135

SEQ ID NO: 159 - protein, 554 aa, Homo sapiens
MRRPLSKCGMEPGGGDASLTLHGLQNRSHGKIKLRKRKSTLYFNTQEKSARRRGDLLGENIYLLLFTIALRILNCFLVQTSFVPDEYWQSLEVSHHMVFNYGYLTWEWTERLRSYTYPLIFASIYKILHLLGKDSVQLLIWIPRLAQALLSAVADVRLYSLMKQLENQEVARWVFFCQLCSWFTWYCCTRTLTNTMETVLTIIALFYYPLEGSKSMNSVKYSSLVALAFIIRPTAVILWTPLLFRHFCQEPRKLDLILHHFLPVGFVTLSLSLMIDRIFFGQWTLVQFNFLKFNVLQNLGTFYGSHPWHWYFSQGFPVILGTHLPFFIHGCYLAPKRYRILLVTVLWTLLVYSMLSHKEFRFIYPVLPFCMVFCGYSLTHLKTWKKPALSFLFLSNLFLALYTGLVHQRGTLDVMSHIQKVCYNNPNKSSASIFIMMPCHSTPYYSHVHCPLPMRFLQCPPDLTGKSHYLDEADVFYLNPLNWLHREFHDDASLPTHLITFSILEEEISAFLISSNYKRTAVFFHTHLPEGRIGSHIYVYERKLKGKFNMKMKF

SEQ ID NO: 160 - protein, 510 aa, Homo sapiens; identical to SEQ ID NO: 150

SEQ ID NO: 161 - protein, 373 aa, Homo sapiens
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPDVMVVGEPTLMGGEFGDEDERLITRLENTQYDAANGMDDEEDFNNSPALGNNSPWNSKPPATQETKSENPPPQASQ

SEQ ID NO: 162 - protein, 373 aa, Homo sapiens
MLKRKPSNVSEKEKHQKPKRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIKKGDIIDIICKTPMGMWTGMLNNKVGNFKFIYVDVISEEEAAPKKIKANRRSNSKKSKTLQEFLERIHLQEYTSTLLLNGYETLEDLKDIKESHLIELNIENPDDRRRLLSAAENFLEEEIIQEQENEPEPLSLSSDISLNKSQLDDCPRDSGCYISSGNSDNGKEDLESENLSDMVHKIIITEPSD

SEQ ID NO: 163 - protein, 218 aa, Homo sapiens
MGSAALEILGLVLCLVGWGGLILACGLPMWQVTAFLDHNIVTAQTTWKGLWMSCVVQSTGHMQCKVYDSVLALSTEVQAARALTVSAVLLAFVALFVTLAGAQCTTCVAPGPAKARVALTGGVLYLFCGLLALVPLCWFANIVVREFYDPSVPVSQKYELGAALYIGWAATALLMVGGCLLCCGAWVCTGRPDLSFPVKYSAPRRPTATGDYDKKNYV

SEQ ID NO: 164 - protein, 178 aa, Homo sapiens
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 165 - protein, 76 aa, Homo sapiens
MMEVESSYSDFISCDRTGRRNAVPDIQGDSEAVSVRKLAGDMGELALEGAEGQVEGSAPDKEAGNQPQSSDGTTSS

SEQ ID NO: 166 - protein, 1712 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGAPGPKGWKGDAGECRCTEGDEAIKGLPGLPGPKGFAGINGEPGRKGDKGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 167 - protein, 93 aa, Homo sapiens
MLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 168 - protein, 158 aa, Homo sapiens
MMQKLLKCSRLVLALALILVLESSVQGYPTRRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 169 - protein, 487 aa, Homo sapiens
MERSGQRVTTWDCDQGKHSDSDYREDGMDLGSDAGSSSSSSRASSQSNSTKVTPCSECKSSSSPGGSLDLVSALEDYEEPFPVYQKKVIDEWAPEEDGEEEEEEDERDQRGYRDDRSPAREPGDVSARTRSGGGGGRSATTAMPPPVPNGNLHQHDPQDLRHNGNVVVAGRPSCSRGPRRAIQKPQPAGGRRSGRGPAAGGLCLQPPDGGTCVPEEPPVPPMDWEALEKHLAGLQFREQEVRNQGQARTNSTSAQKNERESIRQKLALGSFFDDGPGIYTSCSKSGKPSLSSRLQSGMNLQICFVNDSGSDKDSDADDSKTETSLDTPLSPMSKQSSSYSDRDTTEEESESLDDMDFLTRQKKLQAEAKMALAMAKPMAKMQVEVEKQNRKKSPVADLLPHMPHISECLMKRSLKPTDLRDMTIGQLQVIVNDLHSQIESLNEELVQLLLIRDELHTEQDAMLVDIEDLTRHAESQQKHMAEKMPAK

SEQ ID NO: 170 - protein, 158 aa, Homo sapiens; identical to SEQ ID NO: 168

SEQ ID NO: 171 - protein, 577 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 172 - protein, 777 aa, Homo sapiens; identical to SEQ ID NO: 146

SEQ ID NO: 173 - protein, 706 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 174 - protein, 488 aa, Homo sapiens
MFAAGLAPFYASNFSLWSAAYCSSAGPGGCSFPLDPAAVKKPSFCIADILHAGVGDLGAAPEGLAGASAAALTAHLGSVHPHASFQAAARSPLRPTPVVAPSEVPAGFPQRLSPLSAAYHHHHPQQQQQQQQPQQQQPPPPPRAGALQPPASGTRVVPNPHHSGSAPAPSSKDLKFGIDRILSAEFDPKVKEGNTLRDLTSLLTGGRPAGVHLSGLQPSAGQFFASLDPINEASAILSPLNSNPRNSVQHQFQDTFPGPYAVLTKDTMPQTYKRKRSWSRAVFSNLQRKGLEKRFEIQKYVTKPDRKQLAAMLGLTDAQVKVWFQNRRMKWRHSKEAQAQKDKDKEAGEKPSGGAPAADGEQDERSPSRSEGEAESESSDSESLDMAPSDTERTEGSERSLHQTTVIKAPVTGALITASSAGSGGSSGGGGNSFSFSSASSLSSSSTSAGCASSLGGGGASELLPATQPTASSAPKSPEPAQGALGCL

SEQ ID NO: 175 - protein, 538 aa, Homo sapiens
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 176 - protein, 680 aa, Homo sapiens
MALDGIRMPDGCYADGTWELSVHVTDLNRDVTLRVTGEVHIGGVMLKLVEKLDVKKDWSDHALWWEKKRTWLLKTHWTLDKYGIQADAKLQFTPQHKLLRLQLPNMKYVKVKVNFSDRVFKAVSDICKTFNIRHPEELSLLKKPRDPTKKKKKKLDDQSEDEALELEGPLITPGSGSIYSSPGLYSKTMTPTYDAHDGSPLSPTSAWFGDSALSEGNPGILAVSQPITSPEILAKMFKPQALLDKAKINQGWLDSSRSLMEQDVKENEALLLRFKYYSFFDLNPKYDAIRINQLYEQAKWAILLEEIECTEEEMMMFAALQYHINKLSIMTSENHLNNSDKEVDEVDAALSDLEITLEGGKTSTILGDITSIPELADYIKVFKPKKLTLKGYKQYWCTFKDTSISCYKSKEESSGTPAHQMNLRGCEVTPDVNISGQKFNIKLLIPVAEGMNEIWLRCDNEKQYAHWMAACRLASKGKTMADSSYNLEVQNILSFLKMQHLNPDPQLIPEQITTDITPECLVSPRYLKKYKNKQITARILEAHQNVAQMSLIEAKMRFIQAWQSLPEFGITHFIARFQGGKKEELIGIAYNRLIRMDASTGDAIKTWRFSNMKQWNVNWEIKMVTVEFADEVRLSFICTEVDCKVVHEFIGGYIFLSTRAKDQNESLDEEMFYKLTSGWV

SEQ ID NO: 177 - protein, 151 aa, Homo sapiens
MAESRQDLEEEYEPQFLRLLERKEAGTKALQRTQAEIQEMKEALRPLQAEARQLRLQNRNLEDQIALVRQKRDEEVQQYREQLEEMEERQRQLRNGVQLQQQKNKEMEQLRLSLAEELSTYKAMLLPKSLEQADAPTSQAGGMETQSQGAV

SEQ ID NO: 178 - protein, 15 aa, Homo sapiens
ATATCATCTATGGTG

SEQ ID NO: 179 - protein, 290 aa, Homo sapiens
MGGGAGERLFTSSCLVGLVPLGLRISLVTCPLQCGIMWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 180 - protein, 667 aa, Homo sapiens; identical to SEQ ID NO: 123

SEQ ID NO: 181 - protein, 235 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKQF

SEQ ID NO: 182 - protein, 1138 aa, Homo sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 183 - protein, 496 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 184 - protein, 189 aa, Homo sapiens
MINTQDSSILPLSNCPQLQCCRHIVPGPLWCSDAPHPLSKIPGGRGGGRDPSLSALIYKDEKLTVTQDLPVNDGKPHIVHFQYEVTEVKVSSWDAVLSSQSLFVEIPDGLLADGSKEGLLALLEFAEEKMKVNYVFICFRKGREDRAPLLKTFSFLGFEIVRPGHPCVPSRPDVMFMVYPLDQNLSDED

What is claimed is:

1. A method for treating colon cancer in a mammal in need thereof comprising:

(a) measuring an expression level of an RNA transcript or its expression product in a colon cancer tissue biological sample from the mammal wherein the RNA transcript is a collagen type IV transcript;

(b) administering a VEGFR-2 modulator comprising [(1R),2S]-2-aminopropionic acid 2-[4-(4-fluoro-2-methyl-1H-indol-5-yloxy)-5-methylpyrrolo[2,1-f][1,2,4]triazin-6-yloxy]-1-methylethyl ester to said mammal;

(c) following the administering of step (b), measuring in the mammal said expression level of said RNA transcript or its expression product in said cancer tissue biological sample, wherein a decrease in said expression level of step (c) compared to said expression level of step (a) indicates that the mammal will respond therapeutically to said method of treating colon cancer.

2. A method for predicting whether a mammal in need thereof will respond therapeutically to a colon cancer treatment, said method comprising:

(a) measuring an expression level of an RNA transcript or its expression product in a colon cancer tissue biological sample from the mammal wherein the RNA transcript is a collagen type IV transcript;
(b) administering a colon cancer treatment comprising [(1R),2S]-2-aminopropionic acid 2-[4-(4-fluoro-2-methyl-1H-indol-5-yloxy)-5-methylpyrrolo[2,1-f][1,2,4]triazin-6-yloxy]-1-methylethyl ester to said mammal
(c) following the administering of step (b), measuring in the mammal said expression level of said RNA transcript or its expression product in said cancer tissue biological sample,
wherein a decrease in said expression level of step (c) compared to said expression level of step (a) predicts that the mammal will respond therapeutically to said cancer treatment.

* * * * *